US009993529B2

(12) United States Patent
Yang et al.

(10) Patent No.: US 9,993,529 B2
(45) Date of Patent: Jun. 12, 2018

(54) STABLE FORMULATIONS OF A HYALURONAN-DEGRADING ENZYME

(75) Inventors: Tzung-Horng Yang, Del Mar, CA (US); Daniel Edward Vaughn, Encinitas, CA (US); Michael James Labarre, San Diego, CA (US); Christopher L. Caster, Del Mar, CA (US); Francois Nicol, Carlsbad, CA (US); Donghyun Kim, San Diego, CA (US)

(73) Assignee: Halozyme, Inc., San Diego, CA (US)

( * ) Notice: Subject to any disclaimer, the term of this patent is extended or adjusted under 35 U.S.C. 154(b) by 0 days. days.

(21) Appl. No.: 13/507,262

(22) Filed: Jun. 15, 2012

(65) Prior Publication Data

US 2013/0022588 A1    Jan. 24, 2013

Related U.S. Application Data

(60) Provisional application No. 61/520,962, filed on Jun. 17, 2011.

(51) Int. Cl.
| | |
|---|---|
| *C07K 14/62* | (2006.01) |
| *C12N 9/24* | (2006.01) |
| *A61K 38/28* | (2006.01) |
| *A61K 47/02* | (2006.01) |
| *C07K 5/06* | (2006.01) |
| *C07K 5/068* | (2006.01) |
| *A61K 38/47* | (2006.01) |
| *A61K 9/00* | (2006.01) |

(52) U.S. Cl.
CPC .......... *A61K 38/28* (2013.01); *A61K 9/0019* (2013.01); *A61K 38/47* (2013.01); *A61K 47/02* (2013.01); *C07K 5/06* (2013.01); *C07K 5/06086* (2013.01); *C07K 14/62* (2013.01); *C12N 9/2402* (2013.01); *C12Y 302/01035* (2013.01)

(58) Field of Classification Search
None
See application file for complete search history.

(56) References Cited

U.S. PATENT DOCUMENTS

| | | | |
|---|---|---|---|
| 3,837,339 A | 9/1974 | Aisenberg et al. | 128/213 |
| 4,002,531 A | 1/1977 | Royer | 435/188 |
| 4,179,337 A | 12/1979 | Davis et al. | 435/181 |
| 4,373,527 A | 2/1983 | Fischell | 604/891.1 |
| 4,562,751 A | 1/1986 | Nason et al. | 74/111 |
| 4,573,994 A | 3/1986 | Fischell et al. | 604/891.1 |
| 4,678,408 A | 7/1987 | Nason | 417/410 |
| 4,685,903 A | 8/1987 | Cable et al. | 604/154 |
| 4,894,443 A | 1/1990 | Greennield et al. | 424/179.1 |
| 4,952,496 A | 8/1990 | Studier et al. | 435/91.41 |
| 4,973,318 A | 11/1990 | Holm et al. | 604/208 |
| 5,001,054 A | 3/1991 | Wagner et al. | 435/14 |
| 5,009,230 A | 4/1991 | Hutchinson | 128/632 |
| 5,033,252 A | 7/1991 | Carter | 53/425 |
| 5,052,558 A | 10/1991 | Carter | 206/439 |
| 5,122,614 A | 6/1992 | Zalipsky | 548/520 |
| 5,279,543 A | 1/1994 | Glikfeld et al. | 604/20 |
| 5,323,907 A | 6/1994 | Kalvelage | 206/531 |
| 5,324,844 A | 6/1994 | Zalipsky | 548/520 |
| 5,433,197 A | 7/1995 | Stark | 600/319 |
| 5,446,090 A | 8/1995 | Harris | 525/54.1 |
| 5,462,535 A | 10/1995 | Bonichsen | 604/272 |
| 5,497,772 A | 3/1996 | Schulman | 600/347 |
| 5,514,646 A | 5/1996 | Chance | 514/3 |
| 5,569,186 A | 10/1996 | Lord et al. | 604/67 |
| 5,586,553 A | 12/1996 | Halili et al. | 600/316 |
| 5,599,323 A | 2/1997 | Bonnichsen et al. | 604/272 |
| 5,612,460 A | 3/1997 | Zalipsky | 530/391.9 |
| 5,618,913 A | 4/1997 | Brange | 530/303 |
| 5,626,566 A | 5/1997 | Peteresen et al. | 604/208 |
| 5,643,575 A | 7/1997 | Martinez et al. | 424/194.1 |
| 5,660,163 A | 8/1997 | Schulman et al. | 600/345 |
| 5,672,662 A | 9/1997 | Harris et al. | 525/408 |
| 5,713,353 A | 2/1998 | Castano et al. | 128/663 |
| 5,747,027 A | 5/1998 | Stern et al. | 424/94.62 |
| 5,766,581 A | 6/1998 | Bartley et al. | 424/85.1 |
| 5,783,556 A | 7/1998 | Clark et al. | 514/4 |
| 5,791,344 A | 8/1998 | Schulmannn et al. | 600/347 |
| 5,795,569 A | 8/1998 | Bartley et al. | 424/85.1 |
| 5,808,096 A | 9/1998 | Zalipsky | 548/520 |
| 5,827,721 A | 10/1998 | Stern et al. | 435/201 |
| 5,866,538 A | 2/1999 | Norup et al. | 514/3 |
| 5,900,461 A | 5/1999 | Harris | 525/54.11 |
| 5,919,455 A | 7/1999 | Greennnwald et al. | 424/178.1 |
| 5,932,462 A | 8/1999 | Harris et al. | 435/188 |
| 5,945,676 A | 8/1999 | Khalil et al. | 250/339.12 |
| 5,947,934 A | 9/1999 | Hansen et al. | 604/207 |
| 5,954,643 A | 9/1999 | Van Antwerp et al. | 600/316 |
| 5,984,906 A | 11/1999 | Bonichsen et al. | 604/272 |
| 5,985,263 A | 11/1999 | Lee et al. | 424/85.2 |
| 5,990,237 A | 11/1999 | Bentley et al. | 525/54.2 |
| 6,011,984 A | 1/2000 | Van Antwerp et al. | 600/317 |
| 6,034,054 A | 3/2000 | DeFelippis | 514/3 |
| 6,054,569 A | 4/2000 | Benett et al. | 536/23.2 |
| 6,074,372 A | 6/2000 | Hannnsen | 604/211 |
| 6,110,149 A | 8/2000 | Klitgaard et al. | 604/209 |
| 6,113,906 A | 9/2000 | Greenwald et al. | 424/194.1 |
| 6,214,966 B1 | 4/2001 | Harris | 528/322 |

(Continued)

FOREIGN PATENT DOCUMENTS

| | | |
|---|---|---|
| CA | 1243948 | 11/1988 |
| CN | 102083458 A | 6/2011 |

(Continued)

OTHER PUBLICATIONS

Waley et al., Some peptides of lysine, J. Chem. Soc., 1953, 475-79.*

(Continued)

*Primary Examiner* — Robert B Mondesi
*Assistant Examiner* — Todd M Epstein
(74) *Attorney, Agent, or Firm* — Dentons US LLP; Stephanie Seidman

(57) ABSTRACT

Provided are compositions that are stable formulations of a hyaluronan-degrading enzyme or are stable co-formulations of a fast-acting insulin and a hyaluronan degrading enzyme, including a recombinant human PH20 (rHuPH20).

55 Claims, No Drawings

(56) References Cited

U.S. PATENT DOCUMENTS

| | | | |
|---|---|---|---|
| 6,221,633 B1 | 4/2001 | Ertl | 435/69.4 |
| 6,258,351 B1 | 7/2001 | Harris | 424/78.3 |
| 6,302,869 B1 | 10/2001 | Klitgaard | 604/218 |
| 6,340,742 B1 | 1/2002 | Burg et al. | 530/351 |
| 6,379,339 B1 | 4/2002 | Klitgaard | 604/207 |
| 6,413,507 B1 | 7/2002 | Bentley et al. | 424/78 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,524,280 B2 | 2/2003 | Hansen et al. | 604/207 |
| 6,669,663 B1 | 2/2003 | Thompson | 604/67 |
| 6,551,992 B1 | 4/2003 | DeFelippis | 514/3 |
| 6,554,798 B1 | 4/2003 | Mann et al. | 604/131 |
| 6,558,345 B1 | 5/2003 | Houben et al. | 604/66 |
| 6,558,351 B1 | 5/2003 | Steil et al. | 604/131 |
| 6,560,471 B1 | 5/2003 | Heller et al. | 600/347 |
| 6,574,490 B2 | 6/2003 | Abbink et al. | 600/316 |
| 6,582,404 B1 | 6/2003 | Klitgaard et al. | 604/181 |
| 6,589,229 B1 | 7/2003 | Connelly et al. | 604/890.1 |
| 6,641,533 B2 | 11/2003 | Causey, III et al. | 600/300 |
| 6,737,505 B2 | 5/2004 | Bentley et al. | 528/425 |
| 6,740,042 B1 | 5/2004 | Lerner et al. | 600/543 |
| 6,740,072 B2 | 5/2004 | Starkweather et al. | 604/504 |
| 6,744,350 B2 | 6/2004 | Blomquist | 340/309.16 |
| 6,828,401 B2 | 12/2004 | Nho et al. | 526/333 |
| 6,852,104 B2 | 2/2005 | Blomquist | 604/504 |
| 6,858,736 B2 | 2/2005 | Nho et al. | 546/290 |
| 6,872,200 B2 | 3/2005 | Mann et al. | 604/890.1 |
| 6,892,085 B2 | 5/2005 | McIvor et al. | 600/347 |
| 6,895,265 B2 | 5/2005 | Silver | 600/345 |
| 6,902,548 B1 | 6/2005 | Schuler et al. | 604/289 |
| 6,906,028 B2 | 6/2005 | DeFelippis | 514/3 |
| 6,936,029 B2 | 8/2005 | Mann et al. | 604/131 |
| 6,979,326 B2 | 12/2005 | Mann et al. | 604/890.1 |
| 6,999,854 B2 | 2/2006 | Roth | 700/282 |
| 7,025,743 B2 | 4/2006 | Mann et al. | 604/66 |
| 7,105,330 B2 | 9/2006 | Stern et al. | 435/200 |
| 7,109,878 B2 | 9/2006 | Mann et al. | 340/654 |
| 7,148,201 B2 | 12/2006 | Stern et al. | 514/44 R |
| 7,241,278 B2 | 7/2007 | Moller | 604/211 |
| 7,267,665 B2 | 9/2007 | Steil et al. | 604/131 |
| 7,279,457 B2 | 10/2007 | Pohl | 514/3 |
| 7,299,082 B2 | 11/2007 | Mace et al. | 600/345 |
| 7,317,000 B2 | 1/2008 | Hoeg-Jensen | 514/3 |
| 7,354,420 B2 | 4/2008 | Steil | 604/131 |
| 7,381,425 B1 | 6/2008 | Truong-Le | 424/484 |
| 7,713,929 B2 | 5/2010 | Steiner et al. | 514/2 |
| 7,763,582 B2 | 7/2010 | Lin et al. | 514/3 |
| 7,767,429 B2 | 8/2010 | Frost et al. | 435/201 |
| 7,774,145 B2 | 8/2010 | Brauker et al. | 702/19 |
| 7,781,397 B2 | 8/2010 | Stern et al. | 424/94.62 |
| 7,829,081 B2 | 8/2010 | Bookbinder et al. | 424/94.62 |
| 7,826,879 B2 | 11/2010 | Hoss et al. | 600/347 |
| 7,846,431 B2 | 12/2010 | Bookbinder et al. | 424/94.62 |
| 7,857,760 B2 | 12/2010 | Brister et al. | 600/365 |
| 7,871,607 B2 | 1/2011 | Bookbinder et al. | 424/94.62 |
| 7,885,699 B2 | 2/2011 | Say et al. | 600/347 |
| 7,938,797 B2 | 5/2011 | Estes | 604/66 |
| 7,959,598 B2 | 6/2011 | Estes | 604/65 |
| 8,105,586 B2 | 1/2012 | Bookbinder et al. | 424/94.3 |
| 8,119,593 B2 | 2/2012 | Richardson et al. | 514/5.9 |
| 8,187,855 B2 | 5/2012 | Baker et al. | 435/201 |
| 8,257,699 B2 | 9/2012 | Bookbinder et al. | 424/94.62 |
| 8,318,154 B2 | 11/2012 | Frost et al. | 424/94.5 |
| 8,343,487 B2 | 1/2013 | Baker et al. | 424/94.62 |
| 8,431,124 B2 | 4/2013 | Bookbinder | 424/94.62 |
| 8,431,380 B2 | 4/2013 | Bookbinder | 435/201 |
| 8,450,470 B2 | 5/2013 | Bookbinder | 536/23.2 |
| 8,568,713 B2 | 10/2013 | Frost et al. | 424/94.5 |
| 8,765,685 B2 | 7/2014 | Bookbinder et al. | 514/20.9 |
| 8,772,246 B2 | 7/2014 | Bookbinder et al. | 435/200 |
| 8,927,249 B2 | 1/2015 | Wei et al. | 424/450 |
| 9,084,743 B2 | 7/2015 | Teschner et al. | 514/183 |
| 9,211,315 B2 | 12/2015 | Bookbinder et al. | 424/94.62 |
| 9,284,543 B2 | 3/2016 | Wei et al. | 435/201 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0049999 A1 | 4/2002 | Allen et al. | 800/314 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2002/0164316 A1 | 11/2002 | Karageozian et al. | 424/94.1 |
| 2002/0193634 A1 | 12/2002 | Feng et al. | 564/49 |
| 2003/0114647 A1 | 6/2003 | Harris et al. | 530/402 |
| 2003/0125234 A1* | 7/2003 | Middaugh | G01N 33/6842 435/7.1 |
| 2003/0143596 A1 | 7/2003 | Bentley et al. | 435/6 |
| 2003/0158333 A1 | 8/2003 | Roberts et al. | 530/402 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder | 424/94.61 |
| 2005/0287134 A1 | 12/2005 | Klein | 424/94.61 |
| 2006/0104968 A1 | 5/2006 | Bookbinder | 424/94.61 |
| 2007/0086952 A1 | 4/2007 | Steiner | 424/45 |
| 2007/0134228 A1 | 6/2007 | Stern et al. | 424/94.61 |
| 2007/0191757 A1 | 8/2007 | Steiner et al. | 604/20 |
| 2007/0235365 A1 | 10/2007 | Pohl | 206/529 |
| 2007/0243567 A1 | 10/2007 | Chang | 435/14 |
| 2007/0244467 A1 | 10/2007 | Steiner | 604/518 |
| 2008/0039365 A1 | 2/2008 | Steiner | 514/3 |
| 2008/0039368 A1 | 2/2008 | Steiner | 514/4 |
| 2009/0123367 A1 | 5/2009 | Bookbinder et al. | 424/1.49 |
| 2009/0181032 A1 | 7/2009 | Bookbinder | 424/141.1 |
| 2009/0214505 A1 | 8/2009 | Bookbinder | 424/94.1 |
| 2009/0253175 A1 | 10/2009 | Bookbinder | 435/69.1 |
| 2009/0304665 A1 | 12/2009 | Frost et al. | 424/94.5 |
| 2009/0311237 A1 | 12/2009 | Frost et al. | 424/94.62 |
| 2010/0003238 A1 | 1/2010 | Frost et al. | 424/94.62 |
| 2010/0074885 A1 | 3/2010 | Schiff et al. | 424/130.1 |
| 2010/0143457 A1 | 6/2010 | Wei et al. | 424/450 |
| 2010/0210506 A1 | 8/2010 | Quay et al. | 514/4 |
| 2011/0053247 A1 | 3/2011 | Baker et al. | 435/201 |
| 2011/0066111 A1 | 3/2011 | Teschner et al. | 604/187 |
| 2011/0152359 A1 | 6/2011 | Bookbinder et al. | 435/200 |
| 2011/0212074 A1 | 9/2011 | Frost et al. | 424/85.1 |
| 2012/0020951 A1 | 1/2012 | Shepard et al. | 424/130.1 |
| 2012/0093770 A1 | 4/2012 | Bookbinder et al. | 424/94.62 |
| 2012/0148555 A1 | 6/2012 | Bookbinder et al. | 435/200 |
| 2012/0171153 A1 | 7/2012 | Frost et al. | 424/94.62 |
| 2012/0196348 A1 | 8/2012 | Baker et al. | 424/94.62 |
| 2012/0213767 A1 | 8/2012 | Wei et al. | 424/450 |
| 2012/0251517 A1 | 10/2012 | Frost et al. | 424/94.62 |
| 2012/0251620 A1 | 10/2012 | Bookbinder et al. | 424/450 |
| 2012/0294830 A1 | 11/2012 | Bookbinder et al. | 424/85.2 |
| 2013/0011378 A1 | 1/2013 | Yang et al. | 424/94.3 |
| 2013/0022592 A1 | 1/2013 | Vaughn et al. | 424/94.62 |
| 2013/0058893 A1 | 3/2013 | Bookbinder et al. | 435/200 |
| 2013/0202583 A1 | 8/2013 | Jiang et al. | 424/94.62 |
| 2013/0251786 A1 | 9/2013 | Li et al. | 424/94.62 |
| 2013/0302275 A1 | 11/2013 | Wei et al. | 424/94.62 |
| 2013/0344048 A1 | 12/2013 | Wasserman et al. | 455/552.1 |
| 2014/0135682 A1 | 5/2014 | Frost et al. | 424/94.5 |
| 2014/0199282 A1 | 7/2014 | Bookbinder et al. | 435/200 |
| 2015/0017186 A1 | 1/2015 | Troyer et al. | 424/178.1 |
| 2015/0165059 A1 | 6/2015 | Bookbinder et al. | 424/94.62 |
| 2015/0196623 A9 | 7/2015 | Bookbinder et al. | 424/94.62 |
| 2016/0051640 A1 | 2/2016 | Bookbinder et al. | 424/94.62 |

FOREIGN PATENT DOCUMENTS

| | | |
|---|---|---|
| EP | 0250119 | 12/1987 |
| EP | 1048264 | 11/2000 |
| EP | 0822199 | 9/2004 |
| EP | 1064951 | 8/2007 |
| KR | 10-2011-0021818 | 3/2011 |
| WO | WO 1992/16640 | 10/1992 |

(56) References Cited

FOREIGN PATENT DOCUMENTS

| | | |
|---|---|---|
| WO | WO 1994/28024 | 12/1994 |
| WO | WO 1996/06641 | 3/1996 |
| WO | WO 1998/042376 | 10/1998 |
| WO | WO 1999/029230 | 6/1999 |
| WO | WO 2000/02017 | 1/2000 |
| WO | WO 2001/87925 | 4/2001 |
| WO | WO 2002/49673 | 6/2002 |
| WO | WO 2003/047426 | 6/2003 |
| WO | WO 2004/094630 | 11/2004 |
| WO | WO 2005/000360 | 1/2005 |
| WO | WO 2005/095625 | 10/2005 |
| WO | WO 2005/118799 | 12/2005 |
| WO | WO 2007/047242 | 4/2007 |
| WO | WO 2008/016729 | 2/2008 |
| WO | WO 2009/047766 | 4/2009 |
| WO | WO 2009/134380 | 11/2009 |
| WO | WO 2010/077297 | 7/2010 |
| WO | WO 2010/149772 | 12/2010 |
| WO | WO 2012/174478 | 12/2012 |
| WO | WO 2012/174480 | 12/2012 |

OTHER PUBLICATIONS

Zhang et al., Interactions between macromolecules and ions: the Hofmeister series, Curr. Opin. Chem. Biol., 2006, 10, 658-663.*
Vercruysee et al., Control of enzymatic degradation of hyaluronan by divalent cations, Carbohydrates Res., 1999, 318, 26-37.*
Lin et al., On the role of surface tension in the stabilization of globular proteins, Protein Sci., 1996, 5, 372-81.*
Kita et al., Contribution of the surface free energy perturbation to protein-solvent interactions, Biochemistry, 1994, 33, 15178-89.*
Letter/Written Disclosure of the Supplemental Information Disclosure Statement for the above-referenced application, dated Oct. 10, 2012, 2 pages.
Adams et al., "The c-myc oncogene driven by immunoglobulin enhancers induces lymphoid malignancy in transgenic mice," Nature 318:533-538 (1985).
Alexander et al., "The use of hyaluronidase with insulin in insulin coma therapy" Psychiatr Q. 30(1):89-95 (1956).
Alexander et al., "Expression of the c-myc oncogene under control of an immunoglobulin enhancer in E mu-myc transgenic mice," Mol. Cell Biol. 7:1436-1444 (1987).
Altschul, S., "Basic local alignment search tool," J Molec Biol 215(3):403-410 (1990).
Ansel, H., *Introduction to Pharmaceutical Dosage Forms*, Fourth Edition, Lea & Febiger:Philadelphia, p. 126 (1985).
Arming et al., "In vitro mutagenesis of PH-20 hyaluronidase from human sperm," Eur J Biochem 247(3):810-814 (1997).
Atkinson, M. and E. Leiter, "The NOD mouse model of type 1 diabetes: as good as it gets?" Nature Med. 5:601-604 (1999).
Batra et al., "Insertion of constant region domains of human IgG1 into CD4-PE40 increases its plasma half-life," Molecular Immunol. 30:379-386 (1993).
Becker, R. and A. Frick, "Clinical pharmacokinetics and pharmacodynamics of insulin glulisine," Clinical Pharmacokinetics 47(1):7-20 (2008).
Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).
Bergenstal et al., "Adjust to target in type 2 diabetes: comparison of a simple algorithm with carbohydrate counting for adjustment of mealtime insulin glulisine," Diabetes Care 31:1305-1310 (2008).
Bernoist, C. and P. Chambon, "In vivo sequence requirements of the SV40 early promotor region," Nature 290:304-310 (1981).
Birnbaum et al., "Assembly and dissociation of human insulin and LysB28ProB29-insulin hexamers: a comparison study," Pharm Res. 14(1):25-36 (1997).
Bordier C., "Phase separation of integral membrane proteins in Triton X-114 solution," J Biol Chem. 256(4):1604-1607 (1981).
Brinster et al., "Regulation of metallothionein-thymidine kinase fusion plasmids injected into mouse eggs," Nature 296:39-42 (1982).
Brumeanu et al., "Derivatization with monomethoxypolyethylene glycol of Igs expressing viral epitopes obviates adjuvant requirements," J Immunol. 154:3088-3095 (1995).
Caliceti, P. and F. Veronese, "Pharmacokinetic and biodistribution properties of poly(ethylene glycol)-Trotein conjugates,"Adv. Drug Deliv. Rev. 55(10):1261-1277 (2003).
Carr, D. and S. Gabbe, "Gestational diabetes: detection, management, and implications," Clinical Diabetes 16(1):4-11 (1998).
Carrillo, H. and D. Lipman, "The multiple-sequence alignment problem in biology," SIAM J Applied Math 48:1073-1082 (1988).
Cefalu, W., "Animal models of type 2 diabetes: clinical presentation and pathophysiological relevance to the human condition," ILAR Journal 47(3):186-198 (2006).
Chance et al., "Chemical, physical, and biologic properties of biosynthetic human insulin," Diabetes Care 4(2):147-154 (1993).
Chapman et al., "Therapeutic antibody fragments with prolonged in vivo half-lives," Nature Biotech. 17:780-783 (1999).
Cherr et al., "The dual functions of GPI-anchored PH-20: hyaluronidase and intracellular signaling," Matrix Biol., 20(8):515-525 (2001).
Chiesa et al., "Insulin therapy and carbohydrate counting," Acta Biomed. 76(Suppl 3):44-48 (2005).
Cousens et al., "High level expression of proinsulin in the yeast, *Saccharomyces cerevisiae*," Gene 61(3):265-275 (1987).
Cumber et al., "Structural features of the antibody-A chain linkage that influence the activity and stability of ricin A chain immunotoxins," Bioconj. Chem. 3(5):397-401 (1992).
Danilkovitch-Miagkova et al., "Hyaluronidase 2 negatively regulates RON receptor tyrosine kinase and mediates transformation of epithelial cells by jaagsiekte sheep retrovirus," Proc Natl Acad Sci US A. 100(8):4580-4585 (2003).
DeBoer et al., "The tac promoter: a functional hybrid derived from the trp and lac promoters," Proc. Natl. Acad. Sci. USA 80:21-25 (1983).
DeFelippis et al., "Insulin Chemistry and Pharmacokinetics," Ellenberg and Rifkin's diabetes mellitus, [edited by] Daniel Porte et al., New York : McGraw-Hill, Health Professions Division, c2003, 6th ed., pp. 481-500.
Delpech et al., "Enzyme-linked hyaluronectin: a unique reagent for hyaluronan assay and tissue location and for hyaluronidase activity detection," Anal. Biochem. 229:35-41 (1995).
Devereux et al, "A comprehensive set of sequence analysis programs for the VAX," Nucleic Acids Research 12:387-395 (1984).
Donbrow et al., "Autoxidation of polysorbates," J. Pharm Sci. 67(12):1676-1681 (1978).
Duttaroy et al., "Development of a long-acting insulin analog using albumin fusion technology," Diabetes 54(1):251-258 (2005).
Ernst et al., "Enzymatic degradation of glycosaminoglycans," Critical Reviews in Biochemistry and Molecular Biology 30(5):387-444 (1995).
Felix et al., "Pegylated peptides. IV. Enhanced biological activity of site-directed pegylated GRF analogs," Int. J. Peptide Res. 46:253-264 (1995).
Frost et al., "Purification, cloning, and expression of human plasma hyaluronidase," Biochem. Biophys. Res. Commun. 236(1):10-15 (1997).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Gardner et al., "The complete nucleotide sequence of an infectious clone of cauliflower mosaic virus by M13mp7 shotgun sequencing," Nucleic Acids Res. 9:2871-2888 (1981).
Gilbert, W. and L. Villa-Komaroff, "Useful proteins from recombinant bacteria," Scientific American 242(4):74-94 (1980).
Gildersleeve et al., "Improved procedure for direct coupling of carbohydrates to proteins via reductive amination," 19(7):1485-1490 (2008).

(56) References Cited

OTHER PUBLICATIONS

Girish et al., "Hyaluronidase inhibitors: a biological and therapeutic perspective," Curr Med Chem 16(18):2261-2288 (2009).
Gribskov et al., "Sigma factors from E. coli, B. subtilis, phage SP01, and phage T4 are homologous proteins," Nucl. Acids Res. 14(16):6745-6763 (1986).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature (3)15:115-122 (1985).
Harris, J. and R. Chess, "Effect of pegylation on pharmaceuticals," Nat Rev Drug Discov 2(3):214-221 (2003).
Herrera-Estrella et al., "Expression of chimaeric genes transferred into plant cells using a ti-plasmid-derived vector,"Nature 303:209-213 (1984).
Herrera-Estrella et al., "Light-inducible and chloroplast-associated expression of a chimaeric gene introduced into Nicotiana tabacum using asTi plasmid vector," Nature 310(5973):115-120 (1984).
Hibi et al., "Chondroitinase C activity of *Streptococcus intermedius*," FEMS-Microbiol-Lett. 48(2):121-124 (1989).
Hovingh, P. and A. Linker, "Hyaluronidase activity in leeches (*Hirudinea*)," Comp Biochem Physiol B Biochem Mol Biol. 124(3):319-326 (1999).
Hovorka, R., "Continuous glucose monitoring and closed-loop systems," Diabetic Med. 23:1-12 (2006).
Huston et al., "Protein engineering of antibody binding sites: recovery of specific activity in an anti-digoxin single-chain Fv analogue produced in *Escherichia coli*," Proc. Natl. Acad. Sci. U.S.A. 85(16):5879-5883 (1988).
IUPAC-IUB Commission on Biochemical Nomenclature, "A one-letter notation for amino acid sequences. Tentative rules," J. Biol. Chem. 243:3557-3559 (1968).
IUPAC-IUB, "Abbreviated nomenclature of synthetic poypeptides-polymerized amino acids-revised recommendations," Commission on Biochemical Nomenclature, Biochemistry 11:1726-1731 (1972).
Jay et al., "Construction of a general vector for efficient expression of mammalian proteins in bacteria: use of a synthetic ribosome binding site," Proc. Natl. Acad. Sci. USA 78:5543-5548 (1981).
Jost, F., "Zur Insulinempfidlichkeit der schizophrenen," Weiner Klinische Wochenschrift 70(36):657-661 (1958). [in German].
Jost, F., "Zur Insulinempfidlichkeit der schizophrenen," Weiner Klinische Wochenschrift 70(36):657-661 (1958). [Certified English language translation].
Kalatz et al., "Development of algorithms for feedback-controlled subcutaneous insulin infusion with insulin lispro," Acta Diabetol. 36:215 (1999).
Kelsey et al., "Species- and tissue-specific expression of human alpha 1-antitrypsin in transgenic mice," Genes and Devel. 1:161-171 (1987).
Keup, W., "Amorphes Insulin und Hyaluronidase in de Insulinbehandlung der psychosen," Schweizerische Medizinische Wochenschrift 87(35-36):1128-1131 (1957). [in German].
Keup, W., "Amorphes Insulin und Hyaluronidase in de Insulinbehandlung der psychosen," Schweizerische Medizinische Wochenschrift 87(35-36):1128-1131 (1957). [Certified English language translation].

Kollias et al., "Regulated expression of human A gamma-, beta-, and hybrid gamma beta-globin genes in transgenic mice: manipulation of the developmental expression patterns," Cell 46:89-94 (1986).
Krueger et al., "Sanofi-Aventis seeks the holy grail of insulin," Published on Sep. 28, 2010[online][retrieved on Oct. 1, 2010] Retrieved from:<URL:seekingalpha.com/article/227333-sanofi-aventis-seeks-the-holy-grail-of-insulin [6 pages].
Krumlauf et al., Developmental regulation of alpha-fetoprotein genes in transgenic mice, Mol. Cell. Biol. 5:1639-1648 (1985).
Ladisch et al., "Recombinant human insulin," Biotechnol. Prog. 8:469-478 (1992).
Ladurner, A. and A. Fersht, "Glutamine, alanine or glycine repeats inserted into the loop of a protein have minimal effects on stability and folding rates," J. Mol. Biol. 273(1):330-337 (1997).
Lalancette et al, "Characterization of an 80-kilodalton bull sperm protein identified as PH-20," Biol Reprod. 65(2):628-636 (2001).
Leder et al., "Consequences of widespread deregulation of the c-myc gene in transgenic mice: multiple neoplasms and normal development," Cell. 45:485-495 (1986).
Liberatore, R. and D. Damiani, "Insulin pump therapy in type 1 diabetes mellitus," Jornal de Pediatria 82(4): 249-254 (2006).
Lindholm et al., "Improved postprandial glycemic control with insulin aspart," Diabetes Care 22(5):801-805 (1999).
Louveau, I. and F. Gondret, "GH and insulin affect fatty acid synthase activity in isolated porcine adipocytes in culture without any modifications of sterol regulatory element binding protein-1 expression," J Endocrin. 181:271-280 (2004).
Lowe et al., "Flexible eating and flexible insulin dosing in patients with diabetes: Results of an intensive self-management course," Diabetes Res. Clin. Pract. 80(3):439-443 (2008).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain pegylated peptides," Int. J. Peptide Protein Res. 43:127-138 (1994).
Maa, Y. and C. Hsu, "Aggregation of recombinant human growth hormone induced by phenolic compounds" Int. J. Pharm. 140(2):155-168 (1996).
MacDonald, R., "Expression of the pancreatic elastase I gene in transgenic mice," Hepatology 7:425-515(1987).
Magram et al., "Developmental regulation of a cloned adult beta-globin gene in transgenic mice," Nature 315:338-340 (1985).
Mason et al., "The hypogonadal mouse: reproductive functions restored by gene therapy," Science 234:1372-1378 (1986).
Mayfield, J. and R. White, "Insulin therapy for type 2 diabetes: rescue, augmentation, and replacement of beta-cell function," Am Fam Physican 70(3):489-500 (2004).
McCowen et al., "Stress-induced hyperglycemia," Crit Clin. Care 17(1):107-124 (2001).
Mehvar et al., "Modulation of the pharmacokinetics and pharmacodynamics of proteins by polyethylene glycol conjugation," J. Pharm. Pharmaceut. Sci. 3(1):125-136 (2000).
Michelacci et al., "Chondroitinase C from Flavobacterium heparinum," J. Biol. Chem. 251:1154-1158 (1976).
Molineux, G., "Pegylation: engineering improved biopharmaceuticals for oncology," Pharmacotherapy 23 (8 Pt 2):3S-8S (2003).
Monfardini et al, "A branched monomethoxypoly(ethylene glycol) for protein modification," Bioconjugate Chem. 6: 62-69 (1995).
Mooradian et al., "Narrative review: a rational approach to starting insulin therapy," Ann Intern Med 145(2):125-134 (2006).
Morishita et al., "In situ ileal absorption of insulin in rats: effects of hyaluronidase pretreatment diminishing the mucous/glycocalyx layers," Pharm Res. 21(2):309-316 (2004).
Morrow et al., "Reduction in intrasubject variability in the pharmacokinetic response to insulin after subcutaneous co-administration with recombinant human hyaluronidase in healthy volunteers," Diabetes Technol Ther. 13(10):1039-1045(2011). Epub Jun. 29, 2011.
Muchmore et al., "Benefits of blinded continuous glucose monitoring during a randomized clinical trial," J Diabetes Sci Technol. 5(3):676-680 (2011).

(56) References Cited

OTHER PUBLICATIONS

Muchmore et al., "Review of the Mechanisms of Action and Clinical Efficacy of Recombinant Human Hyaluronidase Coadministration with Current Prandial Insulin Formulations," J Diabetes Sci Technol 4(2):419-428 (2010).
Muchmore, D., "The end point is just the beginning," J Diabetes Sci Technol. 5(5):1287-1289 (2011).
Needleman, S. and C. Wunsch "A general method applicable to the search for similarities in the amino acid sequence of two proteins," J Mol Biol. 48:443-453 (1970).
Newton et al., "Angiogenin single-chain immunofusions: influence of peptide linkers and spacers between fusion protein domains," Biochemistry 35(2):545-553 (1996).
Ohya, T., and Y. Kaneko, "Novel hyaluronidase from streptomyces," Biochim. Biophys. Acta 198:607-609 (1970).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Pargiter et al., "Use of hyaluronidase in insulin coma," Dis Nery Syst 18(5):194-195 (1957).
Pearson, W. and D. Lipman, "Improved tools for biological sequence comparison," Proc. Natl. Acad. Sci. USA 851:2444-2448 (1988).
Pfutzer et al., "Mealtime glycemic control comparing VIAject™ to Lispro," presented at Biodel Diabetes Technology Meeting 2007 [online]Retrieved from:<URL:files.shareholder.com/downloads/BIOD/488728673x0x156690/7FF7195B-F7D0-427F-AA08-A5673FB8CCF7/Biodel-DiabetesTechnologyMeeting.pdf [33 pages].
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pirrello et al., "Initial experiences with subcutaneous recombinant human hyaluronidase," J Palliat Med. Aug. 2007;10(4):861-864.
Powell et al., "Compendium of excipients for parenteral formulations," PDA J Pharm Sci Technol. 52(5):238-311 (1998).
Rahuel-Clermont et al., "Mechanisms of stabilization of the insulin hexamer through allosteric ligand interactions," Biochemistry. 36(19):5837-5845 (1997).
Raskin et al. "Use of insulin aspart, a fast-acting insulin analog, as the mealtime insulin in the management of patients with type 1 diabetes," Diabetes Care, 23:583-588 (2000).
Readhead et al., "Expression of a myelin basic protein gene in transgenic shiverer mice: correction of the dysmyelinating phenotype," Cell 48:703-712 (1987).
Remmele et al., "Interleukin-1 receptor (IL-1R) liquid formulation development using differential scanning calorimetry," Pharm Res. 15(2):200-208 (1998).
Riet Correa et al., "Potentialization of the action of insulin by hyaluronidase" annales d'endocrinologie 23:27 (1962). [In the French language].
Riet Correa et al., "Potentialization of the action of insulin by hyaluronidase" annales d'endocrinologie 23:27 (1962). [Certified English translation].
Roberts et al., "Chemistry for peptide and protein PEGylation," Advanced Drug Delivery Review 54:459-476 (2002).
Rosskamp et al "Long-acting insulin analogs," Diabetes Care 22(Suppl.2):B109-B113 (1999).
Sato et al., "Cloning and expression in *Escherichia coli* of the gene encoding the Proteus vulgaris chondroitin ABC lyase," Appl. Microbiol. Biotechnol. 41(1):39-46 (1994).
Schwartz and Dayhoff, eds., *Atlas of Protein Science and Structure*, National Biomedical Research Foundation, pp. 353-358 (1979).
Shani, M., "Tissue-specific expression of rat myosin light-chain," Nature 314:283-286 (1985).
Shichiri et al. "Enhanced, simplified glucose sensors: long-term clincial application of wearable artificial endocrine pancrease," Artif. Organs 22:32-42 (1998).

Shimoda et al., "Closed-loop subcutaneous insulin infusion algorithm with a short-acting insulin analog for long-term clinical application of a wearable artificial endocrine pancreas," Front Med Biol Eng (1997) 8(3):197-211 (1997).
Singh et al., "Mechanisms of m-cresol-induced protein aggregation studied using a model protein cytochrome c," J Pharm Sci. 100(5):1679-1689 (2011). Epub date Jan. 12, 2011.
Smith, T. and M. Waterman, "Comparison of biosequences," Advances in Applied Mathematics 2:482-489 (1981).
Soeborg et al., "Absorption kinetics of insulin after subcutaneous administration," Eur. J. Pharm. Sci. 36:78-90 (2009).
Steil et al., "Modeling beta-cell insulin secretion—implications for closed-loop glucose homeostasis," Diabetes Technol Ther 5(6):953-964 (2003).
STN GEN Câesar accession No. 1625, File IMSDRUGNEWS citing: "rHuPH20 Halozyme phase change II, USA (diabetes)," R&D Focus Drug News, Nov. 2008 (4 pages).
Straccia et al.,"Hyaluroidase as an adjunct in insulin coma therapy" Am J Psychiatry 108:702-703 (1952).
Sutton, S. and D. Porter, "Development of the antimicrobial effectiveness as USP chapter <51>," PDA J. Pharm. Sci Technol., 56(6):300-311 (2002).
Swift et al., "Tissue-specific expression of the rat pancreatic elastase I gene in transgenic mice," Cell 38(3):639-646 (1984).
Takahashi et al., "A fluorimetric Morgan-Elson assay method for hyaluronidase activity," Anal. Biochem. 322:257-263 (2003).
Tkalec et al., "Isolation and expression in *Escherichia coli* of cs1A and cs1B, genes coding for the chondroitin sulfate-degrading enzymes chondroitinase AC and chondroitinase B, respectively, from Flavobacterium heparinum," Applied and Environmental Microbiology 66(1):29-35 (2000).
Tsubery et al., "Prolonging the action of protein and peptide drugs by a novel approach of reversible polyethylene glycol modification.," J Biol. Chem 279(37):38118-38124 (2004).
Tsuda et al., "Substrate specificity studies of flavobacterium chondroitinase C and heparitinases towards the glycosaminoglycan-protein linkage region. Use of a sensitive analytical method developed by chromophore-labeling of linkage glycoserines using dimethylaminoazobenzenesulfonyl chloride," Eur. J. Biochem. 262:127-133 (1999).
USP XXII-NF XVII, United States Pharmacopeia Convention, Inc, Rockville, MD., pp. 644-645 (1990).
Van den Berghe et al., "Intensive insulin therapy in the medical ICU," N. Eng. J Med. 354(5):449-461 (2006).
Vaughn et al., "Accelerated pharmacokinetics and glucodynamics of prandial insulins injected with recombinant human hyaluronidase," Diabetes Technology & Therapeutics 345-352 (2009).
Vaughn, D. and D. Muchmore, "Use of recombinant human hyaluronidase to accelerate rapid insulin analogue absorption: experience with subcutaneous injection and continuous infusion," Endocr Pract. 17(6):914-921 (2011). [Epub ahead of print: Dec. 2, 2011].
Veronese et al., "Branched and linear poly(ethylene glycol): influence of the polymer structure on enzymological, pharmacokinetic, and immunological properties of protein conjugates," J. Bioactive Compatible Polymers 12:197-207 (1997).
Vora et al., "Recombinant DNA derived monomeric insulin analogue: comparison with soluble human insulin in normal subjects," BMJ 297(6658):1236-1239 (1988).
Voyer et al., "Insulinotherapie avec alidase en plusieurs injections," L'Union Med. Canada 86:861-865 (1957). [in the French language].
Voyer et al., "Insulinotherapie avec alidase en plusieurs injections," L'Union Med. Canada 86:861-865 (1957). [Certified English language translation].
Wagner et al., "Nucleotide sequence of the thymidine kinase gene of herpes simplex virus type 1," Proc. Natl. Acad. Sci. USA 78:1441-1445 (1981).
Wang et al., "The molecular physiology of hepatic nuclear factor 3 in the regulation of gluconeogenesis," J. Biol Chem. 275(19):14717-14721 (2000).

(56) References Cited

OTHER PUBLICATIONS

Weinzimer et al., "Fully automated closed-loop insulin delivery versus semiautomated hybrid control in pediatric patients with type 1 diabetes using an artificial pancreas," Diabetes Care 31(5):934-939 (2008).
Weiss et al., "Activities of monomeric insulin analogs at position A8 are uncorrelated with their thermodynamic stabilities," J. Biol. Chem. 276(43):40018-40024 (2001).
Whitlow et al., "An improved linker for single-chain Fv with reduced aggregation and enhanced proteolytic stability," Protein Engineering 6(8):989-995 (1993).
Wollmer et al., "Phenol-promoted structural transformation of insulin in solution," Biol Chem Hoppe Seyler. 368(8):903-911 (1987).
Yamagata et al., "Purification and properties of bacterial chondroitinases and chondrosulfatases," J. Biol. Chem. 243: 1523-1535 (1968).
Yamamoto et al., "Identification of a functional promoter in the long terminal repeat of Rous sarcoma virus," Cell 22:787-797 (1980).
Yang et al., "Purification and characterization of heparinase from Flavobacterium heparinum," J. Biol. Chem. 160(30):1849-1857 (1985).
Yocum et al., "Assessment and implication of the allergic sensitivity to a single dose of recombinant human hyaluronidase injection: a double-blind placebo-controlled clinical trial," J Infus Nursing. 30:293-299 (2007).
Notice of Allowance, dated Jul. 13, 2012 in connection with U.S. Appl. No. 12/387,225, 11 pages.
Corrected Notice of Allowability, dated Jul. 30, 2012 in connection with U.S. Appl. No. 12/387,225, 17 pages.
U.S. Appl. No. 13/506,783, filed May 16, 2012, 2012-0251620, Oct. 4, 2012.
U.S. Appl. No. 13/507,261, filed Jun. 15, 2012, 2013-0022592, Jan. 24, 2013.
U.S. Appl. No. 13/507,540, filed Jul. 6, 2012.
U.S. Appl. No. 13/694,005, filed Oct. 18, 2012.
Letter/Written Disclosure of the Supplemental Information Disclosure Statement for the above-referenced application, dated Feb. 19, 2013, 2 pages.
Heller et al, "Insulin's 85th anniversary—An enduring medical miracle" Diabetes research and clinical practice; 78(2): 149-158 (2007).
Holden et al., "Use of Hyaluronidase in insulin coma therapy," British Medical Journal 13:2(5036):85-86 (1957).
Hompesch et al., "Accelerated insulin pharmacokinetics and improved postprandial glycemic control in patients with type 1 diabetes after coadministration of prandial insulins with hyaluronidase" Diabetes Care. 34(3):666-668 (2011). Epub date Jan. 27, 2011.
Hompesch et al., "Improved postprandial glycemic control in patients with type 2 diabetes from subcutaneous injection of insulin lispro with hyaluronidase," Diabetes Technol Ther. 14(3):218-224 (2011). Epub date Dec. 2, 2011.
Frost, G. I., "Halozyme Therapeutics, Inc. Thinking outside the cell," presented at J. P. Morgan Healthcare Conference on Jan. 10, 2013. Presentation. 23 pages.
Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm [82 pages].
News Release, Database Imsdrugnews, "rHuPH20 Halozyme phase change II USA (diabetes)" retrieved from STN Database accession No. 2008:5917 abstract, R&D Focus Drug News, published Nov. 10, 2008, 1 page.
News Release, Baxter Healthcare Corporation, "Hylenex Recombinant (hyaluronidase recombinant human injection, solution [Baxter Healthcare Corporation]" Published Mar. 8, 2010 [online]Retrieved from the internet:URL:web.archive.org/web/20100308011312/http://dailymed.nlm.nih.gov/dailymed/drugInfo.cfm?id=15698 [retrieved on Aug. 24, 2012], 5 pages.

News Release, Lilly, "HUMULIN Lilly insulin, human biosynthetic antidiabetic agent," Published on Apr. 2, 2010 [online] Retrieved from:<URL:rxmed.com/b.main/b2.pharmaceutical/b2.1.monographs/CPS-%20Monographs/CPS-%20%28General%20Monographs-%20H%29/HUMULIN.html [retrieved on Aug. 24, 2012], 4 pages.
Transcript, "Halozyme Therapeutics's CEO hosts analyst/investor day conference call (Transcript)," Published on Oct. 2, 2012 [online][retrieved on Oct. 25, 2011] Retrieved from:<URL:seekingalpha.com/article/901141-halozyme-therapeutics-s-ceo-hosts-analyst-investor-day-conference-call-transcript?part=single [49 pages].
News Release, "Halozyme Therapeutics to present at the 31st Annual J.P. Morgan Healthcare Conference," Published Jan. 3, 2013 [online][Retrieved Jan. 17, 2013][ Retrieved from:<URL:halozyme.com/Investors/News-Releases/News-Release-Details/2013/Halozyme-Therapeutics-to-Present-at-the-31st-Annual-JP-Morgan-Healthcare-Conference1132508/default.aspx, 2 pages.
Partial International Search Report, dated Sep. 7, 2012, in connection with International Patent Application No. PCT/US2012/042816, 6 pages.
U.S. Appl. No. 13/815,804, filed Mar. 15, 2013.
Letter/Written Disclosure of the Supplemental Information Disclosure Statement for the above-referenced application, mailed the same day herewith, 2 pages.
Morrow et al., "Comparative Pharmacokinetics and Insulin Action for Three Rapid-Acting Insulin Analogs Injected Subcutaneously With and Without Hyaluronidase," Diabetes Care. 36(2):273-275 (2013).
U.S. Appl. No. 11,238,171, filed Sep. 27, 2005, 2006-0104968, May 18, 2006.
U.S. Appl. No. 12/378,984, filed Feb. 20, 2009, 2009-0181032, Jul. 16, 2009.
U.S. Appl. No. 12/381,063, filed Mar. 6, 2009, 2010-0003237, Jan. 7, 2010.
U.S. Appl. No. 12/386,473, filed Apr. 16, 2009, 2009-0214505, Aug. 27, 2009.
U.S. Appl. No. 12/387,225, filed Apr. 28, 2009, 2009-0304665, Dec. 10, 2009.
U.S. Appl. No. 12/355,657, filed Jun. 3, 2009, 2009-0253175, Oct. 8, 2009.
U.S. Appl. No. 12/653,245, filed Dec. 9, 2009, 2010-0143457, Jun. 10, 2010.
U.S. Appl. No. 12/660,894, filed Mar. 5, 2010, 2010-0284995, Nov. 11, 2010.
U.S. Appl. No. 12/928,890, filed Dec. 21, 2010, 2011-0152359, Jun. 23, 2011.
U.S. Appl. No. 13/135,817, filed Jul. 15, 2011, 2012-0020951, Jan. 26, 2012.
U.S. Appl. No. 13/200,666, filed Sep. 27, 2011, 2012/0108455, Sep. 27, 2011.
U.S. Appl. No. 13/374,500, filed Dec. 28, 2011, 2012-0148555, Jun. 14, 2012.
U.S. Appl. No. 13/385,527, filed Feb. 21, 2012, 2012-0213767, Aug. 23, 2012.
U.S. Appl. No. 13/385,528, filed Feb. 22, 2012, 2012-0171153, Jul. 5, 2012.
U.S. Appl. No. 13/385,919, filed Mar. 13, 2012, 2012-0196348, Aug. 2, 2012.
U.S. Appl. No. 13/506,783, filed May 16, 2012.
U.S. Appl. No. 13/506,844, filed May 18, 2012.
U.S. Appl. No. 13/507,263, filed Jun. 15, 2012.
U.S. Appl. No. 13/507,261, filed Jun. 15, 2012.
Letter/Written Disclosure of the Information Disclosure Statement for the above-referenced application, mailed on Sep. 17, 2012, 2 pages.
Bergenstal et al., "Human hyaluronidase+rapid analog insulin (RAI) improves postprandial glycemic control in type 2 diabetes (T2DM) compared to insulin lispro alone," Presented at the American Diabetes Association Annual Meeting, Philadephia, PA, Abstract (882-P) [Available on-line May 25, 2012], 2 pages.
Hirsch et al., "Human hyaluronidase+rapid analog insulin (RAI) improves postprandial glycemic control in type 2 diabetes (T2DM)

(56) References Cited

OTHER PUBLICATIONS compared to insulin lispro alone," Presented at the American Diabetes Association Annual Meeting, Philadephia, PA, Abstract (3053-OR) [Available on-line May 25, 2012], 2 pages.
Hirsch et al., "Human hyaluronidase+rapid analog insulin (RAI) improves postprandial glycemic control in type 2 diabetes (T2DM) compared to insulin lispro alone," Presented Jun. 11, 2012 at American Diabetes Association Annual Meeting, Philadelphia, PA. Oral Presentation (3053-OR), 23 pages.
Kang et al., "Chronic treatment with PEGylated human recombinant PH20 hyaluronidase (PEGPH20) reverses diet-induced insulin resistance (IR) in mice," ADA May 2011. Abstract 1526-P, 2 pages.
Kang et al., "Chronic treatment with PEGylated human recombinant PH20 hyaluronidase (PEGPH20) reverses diet-induced insulin resistance (IR) in mice," ADA May 2011. Poster, 21 pages.
Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, Abstract, 1 page.
Morrow et al., "Addition of human hyaluronidase to rapid analog insulin reduces the absolute variability of early insulin absorption across infusion set life," American Diabetes Association Scientific Sessions, held on Jun. 26, 2011 in San Diego, CA, Abstract, 2 pages.
Morrow et al., "Human hyaluronidase coinjection accelerates insulin pharmacokinetics and glucodynamics of 3 rapid insulin analogs," American Diabetes Association Scientific Sessions, held on Jun. 28, 2010 in Orlando, FL., Oral Presentation, 18 pages.
Muchmore et al., "Human hyaluronidase coinjection consistently accelerates prandial insulin pharmacokinetics (PK) and glucodynamics (GD) across studies and populations," [online][retrieved on Jun. 22, 2011] Retrieved from:<URL:halozyme.com/ADA%202011Consistency%20Poster%20v2.1.pdf, [2 pages].
Muchmore et al., "Improved consistency of pharmacokinetic (PK) and glucodynamic (GD) responses using recombinant human hyaluronidase (rHuPH20) pretreatment with continuous subcutaneous insulin infusion (CSII) in type 1 diabetes (T1DM)," Diabetes Technology Society Meeting Oct. 27-29, 2011 in San Francisco, CA. Abstract, 1 page.
Muchmore et al., "Initial clinical experience with hyaluronidase preadministration in the treatment of type 1 diabetes by sensor augmented analog insulin pump therapy," Presented at the American Diabetes Association Annual Meeting, Philadelphia, PA, Abstract (34-LB) [Available on-line May 25, 2012], 2 pages.
Muchmore et al., "Recombinant human hyaluronidase (rHuPH20) accelerates rapid insulin analog pharmacokinetics (PK) when delivered either by subcutaneous injection or by continuous subcutaneous insulin infusion (CSII)," Presented at AACE Apr. 14, 2011, Oral presentation, 27 pages.
Pinkstaff et al., "Evaluation of the compatibility and pharmacokinetics of co-formulated biologics with recombinant human hyaluronidase: dose response," American Association of Pharmaceutical Scientists Conference, Jun. 2006, San Antonio, TX. Abstract, 2 pages.
Pinkstaff et al., "Evaluation of the compatibility and pharmacokinetics of co-formulated biologics with recombinant human hyaluronidase: dose response," American Association of Pharmaceutical Scientists Conference, Jun. 2006, San Antonio, TX. Poster, 1 page.
Pinkstaff et al., "Recombinant human hyaluronidase for drug and fluid dispersion," American Association of Pharmaceutical Scientists Annual Meeting, Nov. 2006, Boston, MA, Abstract, 2 pages.
Sugarman et al., "Recombinant human hyaluronidase (rHuPH20) accelerates insulin pharmacokinetics in dogs," Jun. 23, 2009 AAPS National Biotechnology Conference, held on Jun. 23, 2009, Abstract, 2 pages.
Vaughn et al., "Human hyaluronidase (rHuPH20) provides consistent ultrafast insulin absorption and action over 3 days of continuous subcutaneous infusion," Presented at the American Diabetes Association Annual Meeting, Philadephia, PA, Abstract (905-P) [Availble on-line May 25, 2012], 2 pages.
Yocum et al., "Pharmacokinetics and glucodynamics of an insulin analog and regular insulin injected with recombinant human hyaluronidase: Fast-acting insulins made faster," American Diabetes Association 68th Scientific Sessions, Jun. 6-10, 2008 San Francisco, CA, abstract 2-LB [1 page].
Beasley, D., "Halozyme keeps options open for ultrafast insulin,", Published on Jun. 26, 2011[online][retrieved on Jul. 25, 2011] Retrieved from:<URL:reuters.com/article/2011/06/26/us-diabetes-halozyme-idUSTRE75P1YM20110626 [1 page].
News Release [on-line], Halozyme Therapeutics Inc., "Halozyme's Ultrafast Insulin Demonstrates Reduced Variability of Insulin Absorption for Type 1 Diabetes Patients Using Insulin Pumps," published Jun. 24, 2011, [retrieved on Sep. 10, 2012] [retrieved from the Internet<URL:phx.corporate-ir.net/phoenix.zhtml?c=175436&p=irol-newsArticle&ID=1579735&highlight=] [3 pages].
News Release, "Coinjection of Halozyme's rHuPH20 enzyme accelerates absorption and action of mealtime insulin analogs," published Jun. 28, 2010, [retrieved on Sep. 1, 2010] Retrieved from:<URL:phx.corporate-ir.net/phoenix.zhtml?c=175436&p=irol-newsArticle_print&ID=1442388&highlight= [2 pages].
News Release, "Halozyme's ultrafast insulin accelerates absorption and lowers hyperglycemia and hypoglycemia risk in type 2 diabetes patients," published Jun. 27, 2010, retrieved from: phx.corporate-ir.net/phoenix.zhtml?c=175436&p=irol-newsArticle_print&ID=1442310&highlight= [retrieved on Sep. 1, 2010] [3 pages].
News Release, Halozyme Therapeutics Inc., "Halozyme presents positive data from two ultrafast insulin clinical trials with human hyaluronidase enzyme—rHuPH20—at ADA 2012," Published Jun. 9, 2012 [online][Retrieved on Aug. 9, 2012] Retrieved at URL:halozyme.com/Investors/News-Releases/News-Release-Details/2012/Halozyme-Presents-Positive-Data-from-Two-Ultrafast-Insulin-Clinical-Trials-with-Human-Hyaluronidase-Enzyme---rHuPH20---at-ADA/default.aspx [4 pages].
News Release, Halozyme Therapeutics Inc., "Halozyme study results demonstrate significantly less absorption variability for insulin Lispro administered with PH20 enzyme," Published on Nov. 7, 2009[online], Retrieved from:<URL:earthtimes.org/articles/show/halozyme-study-results-demonstrate-significantly,1033422.shtml [retrieved on Dec. 16, 2009] [3 pages].
News Release, Halozyme Therapeutics, Inc., "First Quarter 2011 Financial Results Conference Call Transcript," Published on May 6, 2011[online][retrieved on Jul. 25, 2011] Retrieved from:<URL:phx.corporateir.net/Extenial.File?item=UGFyZW50SUQ9NDI5MDMwfENoaWxkSUQ9NDQ2Mj-I4fFR5cGU9MQ==&t=1 [12 pages].
News Release, Halozyme Therapeutics, Inc., "Halozyme therapeutics announces Phase I clinical trial results demonstrating that the combination of recombinant human hyaluronidase (rHuPH20) with humulin R(R) and with humalog(R) yields faster, more physiologic insulin kinetics and better predictability," Published on Jun. 9, 2008[online][retrieved on Jan. 6, 2009] Retrieved from:<URL:phx.corporate-ir.net/phoenix.zhtml?c=175436&p=irol-newsArticle_Print&ID=1163612&highlight= [3 pages].
News Release, Halozyme Therapeutics, Inc., "Halozyme Therapeutics begins phase 2 clinical trial of insulin with rHuPH20 in type 1 diabetic patients," Published on Nov. 3, 2008[online][retrieved on Jan. 6, 2009] Retrieved from:<URL:phx.corporate-ir.net/phoenix.zhtml?c=175436&p=irol-newsArticle_Print&ID=1220870&highlight= [2 pages].
News Release, Halozyme Therapeutics, Inc., "Halozyme Therapeutics, Inc. study results show faster insulin absorption when administered in combination with wide range of PH20 enzyme concentrations," Published on Oct. 21, 2009[online][retrieved on Apr. 27, 2010] Retrieved from:<URL:in.reuters.com/money/quotes/keyDevelopments?symbol=HALO.O [1 page].
News Release, Halozyme Therapeutics, Inc., "Halozyme's rHuPH20 with recombinant insulin demonstrates glycemic control comparable to Lispro," Published on Nov. 12, 2010[online][retrieved on Nov. 19, 2010] Retrieved

(56) References Cited

OTHER PUBLICATIONS from:<URL:phx.corporate-ir.net/phoenix.zhtml?c=175436&p=irol-newsArticle&ID=1495977&highlight= [3 pages].
News Release, Halozyme Therapeutics, Inc., "Halozyme presents phase 2 results for regular insulin-PH20 confirming faster insulin absorption and superior glucose control," Published on Oct. 1, 2009[online][retrieved on Apr. 12, 2012] Retrieved from:<URL:halozyme.com/default.aspx?SectionId=5cc5ecae-6c48-4521-a1ad-480e593e4835&LanguageId=1&PressReleaseId=fcb4ecce-dad9-47c3-871e-09366c64f9ee [3 pages].
News Release, Halozyme Therapeutics, Inc., "Halozyme Therapeutics announces positive results from enzyme-augmented insulin pump trial," Published on Oct. 27, 2011[online][retrieved on Apr. 12, 2012] Retrieved from:<URL:halozyme.com/Investors/News-Releases/News-Release-Details/default.aspx?PressReleaseId=f73c01d4-cedf-4f65-aab0-a2a33828f55d [3 pages].
News Release, Halozyme Therapeutics, Inc., "Halozyme Therapeutics to Present New Data on the Company's Ultrafast Insulin Programs at ADA 2012," Published Jun. 1, 2012 [online][retrieved on Aug. 7, 2012] Retrieved from:<URL:halozyme.com/Investors/News-Releases/News-Release-Details/2012/Halozyme-Therapeutics-to-Present-New-Data-on-the-Companys-Ultrafast-Insulin-Programs-at-ADA-20121129685/default.aspx [2 pages].
News Release, Halozyme Therapeutics, Inc., "Halozyme's ultrafast insulin demonstrates reduced variability of insulin absorption for type 1 diabetes patients using insulin pumps," Published on Jun. 24, 2011[online][retrieved on Apr. 12, 2012] Retrieved from:<URL:halozyme.com/default.aspx?SectionId=5cc5ecae-6c48-4521-alad480e593e4835&LanguageId=1&PressReleaseId=11dd7a86-2824-441f-b19c-ee06c2c8737d [3 pages].
News Release, Halozyme Therapeutics, Inc., "Halozyme's ultrafast insulin formulations improved postprandial glycemic control in patients living with Type 1 diabetes: Phase 2 study results presented at ADA 2012," [online][retrieved on Aug. 7, 2012] Retrieved from: <URL:halozyme.com/Investors/News-Releases/News-Release-Details/2012/Halozymes-Ultrafast-Insulin-Formulations-Improved-Postprandial-Glycemic-Control-in-Patients-Living-with-Type-1-Diabetes-Phase/default.aspx [3 pages].
News Release, Halozyme Therapeutics, Inc., "Halozyme's ultrafast insulin generates faster-in and faster-out profile for type 1 diabetes patients using insulin pumps," Published on Apr. 14, 2011[online][retrieved on Apr. 12, 2012] Retrieved from:<URL:halozyme.com/Investors/News-Releases/News-Release-Details/2011/Halozymes-Ultrafast-Insulin-Generates-Faster-In-and-Faster-Out-Profile-for-Type-1-Diabetes-Patients-Using-Insulin-Pumps/default.aspx [1 page].
U.S. Appl. No. 13/507,540, filed Jul. 6, 2012, 2012-0294830, Nov. 22, 2012.
U.S. Appl. No. 13/694,005, filed Oct. 18, 2012, 2013-0058893, Mar. 7, 2013.
U.S. Appl. No. 13/694,071, filed Oct. 24, 2012.
U.S. Appl. No. 13/684,731, filed Dec. 28, 2012.
U.S. Appl. No. 13/815,311, filed Feb. 19, 2013.
U.S. Appl. No. 13/815,553, filed Mar. 8, 2013.
Letter/Written Disclosure of the Supplemental Information Disclosure Statement for the above-referenced application, mailed on Mar. 29, 2013, 2 pages.
Yocum et al., "Pharmacokinetics and glucodynamics of an insulin analog injected with recombinant human hyaluronidase: fast-acting insulin analog made faster." Database ADISCTI [Online] Oct. 9, 2008, ADIS Title: "Insulin lispro +/− hyaluronidase: pharmacokinetics in volunteers," retrieved from STN Database accession No. 2008:35541. Abstract, 68th Annual Scientific Sessions of the American Diabetes Association, San Francisco, CA, USA Jun. 2008, 3 pages.

International Search Report and Written Opinion, dated Mar. 13, 2013, in connection with International Patent Application No. PCT/US2012/042816, 29 pages.
Letter/Written Disclosure of the Supplemental Information Disclosure Statement for the above-referenced application, mailed Feb. 11, 2014, 2 pages.
Bookbinder et al., "A recombinant human enzyme for enhanced interstitial transport of therapeutics," J Control Release, 114:230-241 (2006).
Clinical Trial: "CONSISTENT 1: Metabolic and Safety Outcomes of Hylenex Recombinant (Hyaluronidase Human Injection) Preadministered at CSII Infusion Site in Subjects With Type 1 Diabetes (T1DM)." ClinicalTrials.gov identifier: NCT01848990; last updated Jun. 28, 2013 Retrieved at: http://clinicaltrials.gov/ct2/show/NCT01848990?term=117-403&rank=1 [retrieved on Jul. 2, 2013], 5 pages.
Fransson et al., "Solvent effects on the solubility and physical stability of human insulin-like growth factor I," Pharm Res. 14(5):606-12 (1997).
Girish, K.S. and K. Kemparaju, "The magic glue hyaluronan and its eraser hyaluronidase: a biological overview," Life Sci. May 1, 2007;80(21):1921-1943.
Morrow et al., "Comparative Pharmacokinetics and Insulin Action for Three Rapid-Acting Insulin Analogs Injected Subcutaneously With and Without Hyaluronidase," Diabetes Care. 36(2):273-275 (2013). Epub Oct. 5, 2012.
Muchmore, D.B. and D.E. Vaughn, "Accelerating and improving the consistency of rapid-acting analog insulin absorption and action for both subcutaneous injection and continuous subcutaneous infusion using recombinant human hyaluronidase," J Diabetes Sci Technol. 6(4):764-772 (2012).
Reed et al., "Removal rate of [3H]hyaluronan injected subcutaneously in rabbits," Am J Physiol. 259(2 Pt 2):H532-H535 (1990).
Roche, "Towards an artificial pancreas," [online] Retrieved on Jul. 31, 2009. Retrieved from:<URL:roche.com/pages/downloads/science/pdf/rtdcmannh02-6.pdf [11 pages].
Tyndel, M., "Hyaluronidase as an adjuvant in insulin shock therapy" J Am Med Assoc,162(1):32-34 (1956).
Bergenstal et al., "Human Hyaluronidase+Rapid Analog Insulin (RAI) Improves Postprandial Glycemic Control in Type 2 Diabetes (T2DM) Compared to Insulin Lispro Alone," Presented Jun. 10, 2012 at the American Diabetes Association Annual Meeting, Philadelphia, PA: Poster 882-P and individual panels, 7 pages.
Hompesch et al., "Accelerated insulin pharmacokinetics and improved glycemic control in T1DM patients by coadministration of prandial insulin with recombinant human hyaluronidase," Part 2, European Association for the Study of Diabetes, held on Sep. 29-Oct. 2, 2009, Poster #953 and individual panels, 7 pages.
Keller et al., "Pharmacokinetic, Pharmacodynamic and Toxicologic Effects of a Recombinant Human Hyaluronidase (rHuPH20) in Rodent and Non-Human Primate models," Hyaluronan (ISHAS) 2007, Charleston, SC. Poster and individual panels, 14 pages.
Muchmore et al., "Improved Postprandial Glucose after Mixed Meals with Preadministration of Hyaluronidase at Each Infusion Site Change During CSII in T1DM," American Diabetes Association 73rd Scientific Sessions, presented Jun. 23, 2013 in Chicago, IL. Abstract #969-P, 2 pages.
Muchmore et al., "Improved Postprandial Glucose after Mixed Meals with Preadministration of Hyaluronidase at Each Infusion Site Change During CSII in T1DM," American Diabetes Association 73rd Scientific Sessions, presented Jun. 23, 2013 in Chicago, IL. Poster #969-P and individual panels, 10 pages.
Muchmore et al., "Initial Clinical Experience with Hyaluronidase Preadministration in the Treatment of Type 1 Diabetes by Sensor Augmented Analog Insulin Pump Therapy" Presented Jun. 10, 2012 at the American Diabetes Association Annual Meeting, Philadelphia, PA, Poster 34-LB and individual panels, 6 pages.
Pinkstaff et al., "Recombinant Human Hyaluronidase for Drug and Fluid Dispersion," American Association of Pharmaceutical Scientists Annual Meeting, Nov. 2006, Boston, MA, Poster and individual panels, 8 pages.
Vaughn et al., "Human hyaluronidase (rHuPH20) provides consistent ultrafast insulin absorption and action over 3 days of continuous

(56) References Cited

OTHER PUBLICATIONS subcutaneous infusion," Presented Jun. 10, 2012 at the American Diabetes Association Annual Meeting, Philadelphia, PA, Poster #905-P and individual panels, 7 pages.
Yocum et al., "Pharmacokinetics and glucodynamics of an insulin analog and regular insulin injected with recombinant human hyaluronidase: Fast-acting insulins made faster," American Diabetes Association 68th Scientific Sessions, Jun. 6-10, 2008 San Francisco, CA. Poster 2-LB and individual panels, 9 pages.
Office Action, dated Jul. 10, 2013, in connection with corresponding U.S. Appl. No. 13/507,263, 22 pages.
Response, filed Oct. 10, 2013, to Office Action, dated Jul. 10, 2013, in connection with corresponding U.S. Appl. No. 13/507,263, 33 pages.
Response to International Search Report and Written Opinion, dated Mar. 13, 2013, in connection with corresponding International Patent Application No. PCT/US2012/042816, 71 pages.
Second Written Opinion, dated Oct. 8, 2013, in connection with corresponding International Patent Application No. PCT/US2012/042816, 14 pages.
Response, dated Dec. 9, 2013, to Written Opinion, dated Oct. 8, 2013, in connection with corresponding International Patent Application No. PCT/US2012/042816, 33 pages.
International Preliminary Report on Patentability, dated Jan. 9, 2014, in connection with corresponding International Patent Application No. PCT/US2012/042816, 14 pages.
U.S. Appl. No. 13/998,040, filed Sep. 24, 2013, 2014-0135682, May 15, 2014.
U.S. Appl. No. 13/999,454, filed Feb. 26, 2014, 2014-0199282, Jul. 17, 2014.
U.S. Appl. No. 14/120,224, filed May 7, 2014.
U.S. Appl. No. 14/323,932, filed Jul. 3, 2014.
Letter/Written Disclosure of the Supplemental Information Disclosure Statement for the above-referenced application, mailed Jul. 28, 2014, 2 pages.
Office Action, dated Apr. 7, 2014, in connection with U.S. Appl. No. 13/507,263, 24 pages.
Letter/Written Disclosure of the Supplemental Information Disclosure Statement for the above-referenced application, filed herewith Apr. 8, 2015, 2 pages.
Response, filed Oct. 7, 2014, to Office Action, dated Apr. 7, 2014, in connection with U.S. Appl. No. 13/507,263, 41 pages.
Office Action, dated Feb. 25, 2015, in connection with Chinese Patent Application No. 201280039713.8, 9 pages [English translation and original document in Chinese], 9 pages.
Examination Report dated, Dec. 8, 2014, in connection with European Patent Application No. 12735366.2, 194 pages [Examination report and cited Reference: D30 (WO 2012/174480)].
Examination Report, dated Oct. 15, 2014, in connection with New Zealand Patent Application No. 618331, 3 pages.
Response, filed Mar. 12, 2015, to Examination Report dated, Dec. 8, 2014, in connection with European Patent Application No. 12735366.2, 81 pages.
Letter/Written Disclosure of the Supplemental Information Disclosure Statement for the above-referenced application, filed herewith Jan. 28, 2016, 2 pages.
Office Action, dated Dec. 17, 2015, in connection with Australian Patent Application No. 2012271359, 3 pages.
Letter/Written Disclosure of the Supplemental Information Disclosure Statement for the above-referenced application, filed herewith Nov. 30, 2015, 2 pages.
Davidson College Biology Home Page, "My favorite protein," [online] Retrieved from:<URL:bio.davidson.edu/courses/molbio/molstudents/spring2005/dresser/my%20favorite%20protein.html] [accessed on Aug. 25, 2014], 7 pages.
Eskens et al., "Enzymatic glycocalyx treatment impairs insulin-mediated recruitment of microvascular blood volume and decreases insulin sensitivity in rats," FASEB Journal 25:1023.13 (2011) (Abstract).

Lin et al., "Molecular cloning of the human and monkey sperm surface protein PH-20," Proc. Natl. Acad. Sci. USA 90:10071-10075 (1993).
"PEGPH20: The Science & The Strategy," presented at J. P. Morgan Healthcare Conference on Jan. 7, 2015. Presentation. 81 pages.
Frost, G., "Halozyme Therapeutics, Inc. Thinking outside the cell," presented at J. P. Morgan Healthcare Conference on Jan. 10, 2013. Presentation. 23 pages.
Torley, H., "Halozyme Therapeutics, Inc. The next chapter begins: creating value through growth," Presented at the 32nd Annual J.P. Morgan Healthcare Conference Jan. 2014, 26 pages.
Office Action, dated Jun. 24, 2015, in connection with U.S. Appl. No. 13/507,263, 33 pages.
Request for Continued Examination, filed Nov. 24, 2015, to Office Action, dated Jun. 24, 2015, in connection with U.S. Appl. No. 13/507,263, 64 pages.
Response, filed Sep. 11, 2015, to Office Action, dated Feb. 25, 2015, in connection with Chinese Patent Application No. 201280039713.8 [English instructions and document as filed in Chinese], 29 pages.
Letter, dated Sep. 14, 2015, reporting Examination Report issued in connection with Eurasian Patent Application No. 201400031 [English letter and Examination Report in Russian], 6 pages.
Communication under Rule 71(3) EPC (Intention to Grant), dated Aug. 11, 2015, in connection with European Patent Application No. 12735366.2, 5 pages.
Office Action, dated Oct. 14, 2015, in connection with Mexican Patent Application No. MX/a/2013/014923 [English language translation and original document in Spanish], 4 pages.
Letter/Written Disclosure of the Information Disclosure Statement for the above-referenced application, filed herewith on Mar. 4, 2016, 2 pages.
Office Action, dated Jan. 25, 2016, in connection with Chinese Patent Application No. 201280039713.8 [English translation and original document in Chinese], 5 pages.
Communication pursuant to Article 97(1) (Decision to Grant), dated Feb. 4, 2016, in connection with European Patent Application No. 12735366.2, 2 pages.
Letter/Written Disclosure of the Supplemental Information Disclosure Statement for the above-referenced application, filed herewith Jul. 7, 2016, 2 pages.
Yocum et al., "Pharmacokinetics and glucodynamics of an insulin analog and regular insulin injected with recombinant human hyaluronidase: Fast-acting insulins made faster," American Diabetes Association 68th Scientific Sessions, Jun. 6-10, 2008 San Francisco, CA. Poster 2-LB, [poster and individual frames], 9 pages.
Response, filed Apr. 19, 2016, to Office Action, dated Dec. 17, 2015, in connection with Australian Patent Application No. 2012271359, 26 pages.
Notice of Acceptance, dated May 4, 2016, in connection with Australian Patent Application No. 2012271359, 2 pages.
Response, filed Apr. 11, 2016, to Office Action, dated Jan. 25, 2016, in connection with Chinese Patent Application No. 201280039713.8 [English instructions, revised claims in English and document as filed in Chinese], 42 pages.
Response, filed Nov. 13, 2015, to Examination Report issued in connection with Eurasian Patent Application No. 201400031 [English instructions and Response as filed in Russian], 54 pages.
Letter, dated Mar. 31, 2016, reporting Examination Report, dated Mar. 6, 2016, in connection with Eurasian Patent Application No. 201400031, 15 pages [English letter and Examination Report in Russian].
Office Action, dated Apr. 12, 2016, in connection with Japanese Patent Application No. 2014-516067 [English translation and original document in Japanese], 11 pages.
Response, filed Feb. 5, 2016, to Office Action, dated Oct. 8, 2015, in connection with Mexican Patent Application No. MX/a/2013/014923 [English language instructions and document, as filed, in Spanish], 18 pages.
Letter, dated Apr. 20, 2016, reporting Notice of Allowance issued in connection with Mexican Patent Application No. MX/a/2013/014923 [English letter], 1 page.

(56) References Cited

OTHER PUBLICATIONS

Response, filed Mar. 11, 2016, to Examination Report, dated Oct. 15, 2014, in connection with New Zealand Patent Application No. 618331, 49 pages.
Notice of Acceptance, dated Mar. 31, 2016, in connection with New Zealand Patent Application No. 618331, 1 page.
Notice of Acceptance, dated Apr. 1, 2016, in connection with New Zealand Patent Application No. 717728, 1 page.
Search Report, dated Oct. 22, 2015, and Written Opinion, dated Oct. 28, 2015, in connection with Singaporean Patent Application No. 2013092051, 11 pages.
Response, filed Apr. 25, 2016, to Search Report, dated Oct. 22, 2015, and Written Opinion, dated Oct. 28, 2015, in connection with Singaporean Patent Application No. 2013092051, 44 pages.
Letter/Written Disclosure of the Supplemental Information Disclosure Statement for the above-referenced application, filed herewith on Sep. 27, 2016, 2 pages.
Office Action, dated Aug. 17, 2016, in connection with Chinese Patent Application No. 201280039713.8 [English translation and original document in Chinese], 4 pages.
Letter/Written Disclosure of the Supplemental Information Disclosure Statement for the above-referenced application, filed herewith on Aug. 11, 2016, 4 pages.
Bonito, A., "The effect of administering hyaluronidase on insulin glycemic curves in normal and diabetic subjects," Minerva Medica, Edizioni Minerva Medica 45(31):1068-1073 (1954); XP 009124588. [Certified English language translation].
Letter, dated Jul. 22, 2016, reporting Examination Report that issued in connection with Indonesian Patent Application No. P00201400130 [English reporting letter, document as issued in the Indonesian language and English language translation], 6 pages.
Search and Examination Report, dated Jun. 30, 2016, in connection with Singaporean Patent Application No. 2013092051, 10 pages.
Letter/Writtten Disclosure of the Information Disclosure Statement for the above-referenced application, filed herewith Dec. 8, 2016, 3 pages.
Examination Report, dated Nov. 14, 2016, in connection with Australian Patent Application No. 2016202472, 3 pages.
Letter, dated Sep. 30, 2016, reporting Certificate of Grant, dated Sep. 9, 2016, in connection with Singapore Patent Application No. 2013092051 [Letter and original Certificate of Grant], 5 pages.
Search Report and Written Opinion, dated Oct. 3, 2016, in connection with Singapore Patent Application No. 10201603659R, 9 pages.
Letter/Written Disclosure of the Supplemental Information Disclosure Statement for the above-referenced application, filed herewith Jan. 13, 2017, 3 pages.
Notice of Preliminary Rejection, dated Nov. 4, 2016, in connection with Korean Patent Application No. 10-2014-7001375 [English translation and original document in Korean], 14 pages.
Notice of Acceptance, dated Jan. 12, 2017, in connection with Australian Patent Application No. 2016202472, 3 pages.
Letter/Written Disclosure of the Supplemental Information Disclosure Statement for the above-referenced application, filed herewith on Nov. 22, 2017, 3 pages.
Notice of Allowance, dated Oct. 20, 2017, issued in connection with corresponding Eurasian Patent Application No. 201400031 [English letter and original document in Russian], 2 pages.
Office Action, dated Oct. 12, 2017, issued in connection with corresponding Korean Patent Application No. 10-2014-7001375 [English translation and original document in Korean; D1=KR Publication No. 10-2011-0021818 (English equivalent=WO 2009/134380)], 5 pages.
Office Action, dated Nov. 1, 2017, issued in connection with corresponding Korean Patent Application No. 10-2017-7027130 [English translation and original document in Korean], 5 pages.
Letter/Written Disclosure of the Supplemental Information Disclosure Statement for the above-referenced application, filed herewith on Oct. 12, 2017, 3 pages.
Decision to Grant, dated Sep. 12, 2017, in connection with corresponding Japanese Patent Application No. 2016-200761 [English letter reporting Decision to Grant and original document in Japanese], 4 pages.
Official Action, dated Sep. 12, 2017, in connection with corresponding Japanese Patent Application No. 2017-111643 [English translation and original document in Japanese], 6 pages.
U.S. Appl. No. 13/694,071, filed Oct. 24, 2012, 2013-0202583, Aug. 8, 2013.
U.S. Appl. No. 13/694,731, filed Dec. 28, 2012, 2013-0302275, Nov. 14, 2013.
U.S. Appl. No. 13/815,311, filed Feb. 19, 2013, 2013-0251786, Sep. 26, 2013.
U.S. Appl. No. 13/998,040, filed Sep. 24, 2013.
U.S. Appl. No. 13/998,058, filed Sep. 25, 2013.

\* cited by examiner

STABLE FORMULATIONS OF A HYALURONAN-DEGRADING ENZYME

RELATED APPLICATIONS

Benefit of priority is claimed to U.S. Provisional Application Ser. No. 61/520,962, entitled "STABLE CO-COFORMULATIONS OF A HYALURONAN-DEGRADING ENZYME AND AN INSULIN," filed Jun. 17, 2011.

This application is related to International Application Serial No. PCT/US2012/042816, filed the same day herewith, entitled "STABLE FORMULATIONS OF A HYALURONAN-DEGRADING ENZYME," which claims priority to U.S. Provisional Application Ser. No. 61/520,962. This application also is related to U.S. application Ser. No. 13/507,263, filed the same day herewith, entitled "STABLE FORMULATIONS OF A HYALURONAN-DEGRADING ENZYME," which claims priority to U.S. Provisional Application Ser. No. 61/520,962. The subject matter of the above-noted related applications is incorporated by reference in its entirety.

This application also is related to U.S. Provisional Application No. 61/520,940 filed Jun. 17, 2011, U.S. Provisional Application No. 61/628,389 filed Oct. 27, 2011, and U.S. Provisional Application No. 61/657,606 filed Jun. 8, 2012, each entitled "Continuous Subcutaneous Insulin Infusion Methods with a Hyaluronan-Degrading Enzyme." This application also is related to U.S. application Ser. No. 13/507,261, filed the same day herewith, entitled "Continuous Subcutaneous Insulin Infusion Methods with a Hyaluronan-Degrading Enzyme," which claims priority to U.S. Provisional Application Ser. Nos. 61/520,940, 61/628,389 and 61/657,606. This application also is related to International PCT Application No. PCT/UJS2012/042818, filed the same day herewith, entitled "Continuous Subcutaneous Insulin Infusion Methods with a Hyaluronan-Degrading Enzyme," which claims priority to U.S. Provisional Application Ser. Nos. 61/520,940, 61/628,389 and 61/657,606.

This application also is related to U.S. application Ser. No. 12/387,225, published as U.S. publication No. US20090304665, to Inventors Gregory Frost, Igor Blinsky, Daniel Vaughn and Barry Sugarman, entitled "Super Fast-Acting Insulin Compositions," filed Apr. 28, 2009, which claims priority to U.S. Provisional Application No. 61/125,835, filed Apr. 28, 2008.

The subject matter of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Jun. 15, 2012, is identical, 860 kilobytes in size, and titled 3085Bseq.001.txt. A substitute Sequence Listing, incorporated by reference in its entirety, is provided on identical compact discs (labeled Copy 1 Replacement Sep. 10, 2012, Copy 2 Replacement Sep. 10, 2012). The computer-readable file on each of the aforementioned compact discs, created on Sep. 10, 2012, is identical, 860 kilobytes in size, and titled 3085seqB.002.txt.

FIELD OF INVENTION

Provided are compositions that are stable formulations of a hyaluronan-degrading enzyme or are stable co-formulations of a fast-acting insulin and a hyaluronan degrading enzyme, including a recombinant human PH20 (rHuPH20).

BACKGROUND

Diabetes results in chronic hyperglycemia due to the inability of the pancreas to produce adequate amounts of insulin or due to the inability of cells to synthesize and release the insulin appropriately. Hyperglycemia also can be experienced by critically ill patients, resulting in increased mortality and morbidity. Insulin has been administered as a therapeutic to treat patients having diabetes, including, for example, type 1 diabetes, type 2 diabetes and gestational diabetes, in order to mimic the endogenous insulin response that occurs in normal individuals. Insulin also has been administered to critically ill patients with hyperglycemia to control blood glucose level.

Typically, fast-acting insulins are administered to such subjects in response to hyperglycemia or in anticipation of hyperglycemia, such as following consumption of a meal, which can result in glycemic control. However, current fast-acting forms of insulins have a delay in absorption and action, and therefore do not approximate the rapid endogenous insulin action. Thus, such formulations do not act quickly enough to shut off hepatic glucose production that occurs shortly after this first phase of insulin release. Due to the delay in pharmacological action, the fast-acting insulin preparations should be administered in advance of meals in order to achieve the desired glycemic control. Further, the doses that must be administered lead to an extended duration of action that contributes to hypoglycemia, and in many cases, obesity.

Hyaluronan-degrading enzymes are enzymes that exhibit therapeutic activity alone and/or are co-administered without therapeutic agents, such as insulin. For example, super-fast acting insulin compositions have been developed containing a hyaluronan-degrading enzyme and a fast acting insulin (e.g. rapid acting insulin analog) that results in a composition that, when administered to a subject, more closely mimics the endogenous (i.e., natural) post-prandial insulin release of a nondiabetic subject compared to the fast-acting insulin alone (see e.g. U.S. Pub No. US20090304665). There is a need for improved formulations and co-formulations of hyaluronan-degrading enzymes. There also exists a need for improved stable insulin formulations for treating subjects, for example, to control blood glucose levels in diabetic subjects.

SUMMARY

Provided herein are stable co-formulation compositions containing a therapeutically effective amount of a fast-acting insulin and a hyaluronan-degrading enzyme in an amount sufficient to render the composition super-fast acting. The provided stable co-formulations are formulated for multiple drug injection (MDI) or are formulated for continuous subcutaneous insulin infusion (CSII), each with differing requirements for stability. In particular, co-formulations for CSII are formulated to be stable at elevated temperatures and under agitation, while co-formulations for MDI are formulated to be stable when stored at refrigerated or ambient temperatures.

Provided herein are stable co-formulation compositions containing a therapeutically effective amount of a fast-acting insulin, a hyaluronan-degrading enzyme in an amount sufficient to render the composition super-fast acting, NaCl at a concentration between or about between 50 mM to 200 mM, an anti-microbial effective amount of a preservative or mixture of preservatives and a stabilizing agent or agents. The provided co-formulations have a pH of between or about between 6.8 to 7.8 and are formulated such that the compositions are stable for at least 6 months at a temperature from or from about 2° C. to 8° C. and/or for at least 14 days at a temperature from or from about 20° C. to 30° C.

In some examples, the hyaluronan-degrading enzyme in the stable co-formulation provided herein retains at least 50% of the initial hyaluronidase activity for at least 6 months at a temperature from or from about 2° C. to 8° C. and/or for at least 14 days at a temperature from or from about 20° C. to 30° C. and/or the insulin retains at least 90% potency or recovery of the initial level of insulin in the composition for at least 6 months at a temperature from or from about 2° C. to 8° C. and/or for at least 14 days at a temperature from or from about 20° C. to 30° C. and/or the insulin retains at least 90% of the initial insulin purity for at least 6 months at a temperature from or from about 2° C. to 8° C. and/or for at least 14 days at a temperature from or from about 20° C. to 30° C. and/or the insulin retains less than 2% high molecular weight (HMWt) insulin species for at least 6 months at a temperature from or from about 2° C. to 8° C. and/or for at least 14 days at a temperature from or from about 20° C. to 30° C. For example, the hyaluronan-degrading enzyme in the stable co-formulation retains at least 55%, 60%, 65%, 70%, 80%, 85%, 90%, 95% or more of the initial hyaluronidase activity for at least 6 months at a temperature from or from about 2° C. to 8° C. and/or for at least 14 days at a temperature from or from about 20° C. to 30° C. and the purity or potency of insulin is at least 91%, 92%, 93%, 94%, 95%, 96%, 97%, 98%, 99% or more for at least 6 months at a temperature from or from about 2° C. to 8° C. and/or for at least 14 days at a temperature from or from about 20° C. to 30° C.

In some embodiments, the pH of the stable co-formulation compositions provided herein is between or about between 7.0 to 7.6. For example, the pH of the stable co-formulation is or is about 6.8±0.2, 6.9±0.2, 7.0±0.2, 7.1±0.2, 7.2±0.2, 7.3±0.2, 7.4±0.2, 7.5±0.2, 7.6±0.2, 7.7±0.2 or 7.8±0.2. The NaCl concentration in the stable co-formulation compositions provided herein is between or about between 80 mM to 200 mM, 80 mM to 140 mM, 50 mM to 100 mM, 80 mM to 100 mM, 50 mM to 80 mM, 100 mM to 140 mM or 120 mM to 140 mM. For example, the NaCl concentration of the stable co-formulation is or is about or at least 50 mM, 55 mM, 60 mM, 65 mM, 70 mM, 75 mM, 80 mM, 85 mM, 90 mM, 95 mM, 100 mM, 120 mM, 125 mM, 130 mM, 135 mM, 140 mM, 145 mM, 150 mM, 155 mM, 160 mM, 165 mM, 170 mM, 175 mM, 180 mM, 185 mM, 190 mM, 195 mM or 200 mM. In such examples, the upper amount of NaCl in compositions of less than 100 mM is up to 110 mM, 120 mM, 130 mM, 140 mM, 150 mM, 160 mM, 170 mM, 180 mM, 190 mM or 200 mM. In some examples, the stable co-formulations provided herein contain a sufficient amount of a buffering agent to maintain a pH range of between or about between 6.8 to 7.8.

In one embodiment, the stable co-formulations provided herein are stable at a temperature from or from about 2° C. to 8° C., inclusive, for at least 7 months, at least 8 months, at least 9 months, at least 10 months, at least 11 months, at least 12 months, 13 months, 14 months, 15 months, 16 months, 17 months, 18 months, 19 months, 20 months, 21 months, 22 months, 23 months, 24 months, 25 months, 26 months, 27 months, 28 months, 29 months or 30 months. For example, the co-formulations are stable at a temperature from or from about 2° C. to 8° C., inclusive, for at least 18 months or at least 24 months. In another embodiment, the stable co-formulations provided herein are stable at a temperature from or from about 20° C. to 30° C., inclusive, for at least 15 days, 20 days, 21 days, 22 days, 23 days, 24 days, 25 days, 26 days, 27 days, 28 days, 29 days, 30 days, 35 days, 40 days, 45 days or 50 days. For example, the co-formulations are stable at a temperature from or from about 20° C. to 30° C., inclusive, for at least a month.

Also provided herein are stable co-formulation compositions containing a therapeutically effective amount of a fast-acting insulin, a hyaluronan-degrading enzyme in an amount sufficient to render the composition super-fast acting, NaCl at a concentration between or about between 120 mM to 200 mM, an anti-microbial effective amount of a preservative or mixture of preservatives, and a stabilizing agent or agents. The provided co-formulations have a pH of between or about between 6.5 to 7.5 and the compositions are stable for at least 3 days at a temperature from or from about 32° C. to 40° C. or are stable for at least 3 hours under agitation.

In some examples, the stable co-formulation further contains an effective amount of a hyaluronidase inhibitor, such as, but not limited to, proteins, glycosaminoglycans (GAG), polysaccharides, fatty acids, lanostanoids, antibiotics, anti-nematodes, synthetic organic compounds and/or a plant-derived bioactive component. Exemplary of a plant-derived bioactive component is an alkaloid, antioxidant, polyphenol, flavonoids, terpenoids and/or anti-inflammatory drugs. In some example, the hyaluronidase inhibitor in the stable co-formulations provided herein does not form covalent complexes with the hyaluronan-degrading enzyme or insulin. Exemplary hyaluronidase inhibitors are, but are not limited to, a serum hyaluronidase inhibitor, *Withania somnifera* glycoprotein (WSG), heparin, heparin sulfate, dermatan sulfate, chitosans, β-(1,4)-galacto-oligosaccharides, sulphated verbascose, sulphated planteose, pectin, poly(styrene-4-sulfonate), dextran sulfate, sodium alginate, polysaccharide from *Undaria pinnatifida*, mandelic acid condensation polymer, eicosatrienoic acid, nervonic acid, oleanolic acid, aristolochic acid, ajmaline, reserpine, flavone, desmethoxycentauredine, quercetin, apigenin, kaempferol, silybin, luteolin, luteolin-7-glucoside, phloretin, apiin, hesperidin, sulphonated hesperidin, calycosin-7-O-β-D-glucopyranoside, sodium flavone-7-sulphate, flavone 7-fluoro-4'-hydroxyflavone, 4'-chloro-4,6-dimethoxychalcone, sodium 5-hydroxyflavone 7-sulphate, myricetin, rutin, morin, glycyrrhizin, vitamin C, D-isoascorbic acid, D-saccharic 1,4-lactone, L-ascorbic acid-6-hexadecanoate (Vcpal), 6-O-acylated vitamin C, catechin, nordihydroguaiaretic acid, curcumin, N-propyl gallate, tannic acid, ellagic acid, gallic acid, phlorofucofuroeckol A, dieckol, 8,8'-bieckol, procyanidine, gossypol, celecoxib, nimesulide, dexamethasone, indomethcin, fenoprofen, phenylbutazone, oxyphenbutazone, salicylates, disodium cromoglycate, sodium aurothiomalate, transilist, traxanox, ivermectin, lincomycin and spectinomycin, sulfamethoxazole and trimerthoprim, neomycin sulphate, 3α-acetylpolyporenic acid A, (25S)-(+)-12α-hydroxy-3α-methylcarboxyacetate-24-methyllanosta-8,24(31)-diene-26-oic acid, lanostanoid, polyporenic acid C, PS53 (hydroquinone-sulfonic acid-formaldehyde polymer), polymer of poly(styrene-4-sulfonate), VERSA-TL 502, 1-tetradecane sulfonic acid, mandelic acid condensation polymer (SAMMA), 1,3-diacetylbenzimidazole-2-thione, N-monoacylated benzimidazol-2-thione, N,N'-diacylated benzimidazol-2-thione, alkyl-2-phenylindole derivative, 3-propanoylbenzoxazole-2-thione, N-alkylated indole derivative, N-acylated indole derivative, benzothiazole derivative, N-substituted indole-2- and 3-carboxamide derivatives, halogenated analogs (chloro and fluoro) of N-substituted indole-2- and 3-carboxamide derivatives, 2-(4-hydroxyphenyl)-3-phenylindole, indole carboxamides, indole acetamides, 3-benzolyl-1-methyl-4-phenyl-4-piperidinol, benzoyl phenyl benzoate derivative, 1-arginine derivative, guanidium HCL, L-NAME, HCN, linamarin, amygdalin, hederagenin, aescin, CIS-hinokiresinol and/or 1,3-di-p-hydroxyphenyl-4-penten-1-one.

In some embodiments, the stable co-formulations provided herein contain a hyaluronidase inhibitor that is a hyaluronan (HA) oligosaccharide at a concentration of between or about between 1 mg/mL to 20 mg/mL. In some examples, the HA oligosaccharide is a disaccharide or a tetrasaccharide. In other examples, the HA oligosaccharide has a reacted reducing end.

The stable co-formulations provided herein are formulated such that the hyaluronan-degrading enzyme in the co-formulation retains at least 50% of the initial hyaluronidase activity for at least 3 days at a temperature from or from about 32° C. to 40° C. or is stable for at least 3 hours under agitation; and/or the insulin in the composition retains at least 90% potency or recovery of the initial level of insulin in the composition for at least 3 days at a temperature from or from about 32° C. to 40° C. or is stable for at least 3 hours under agitation, and/or retains at least 90% of the initial insulin purity for at least 3 days at a temperature from or from about 32° C. to 40° C. or is stable for at least 3 hours under agitation, and/or retains less than 2% high molecular weight (HMWt) insulin species for at least 3 days at a temperature from or from about 32° C. to 40° C. or is stable for at least 3 hours under agitation. In one example, the stable co-formulations are formulated such that the hyaluronan-degrading enzyme in the composition retains at least 55%, 60%, 65%, 70%, 80%, 85%, 90%, 95% or more of the initial hyaluronidase activity for at least 3 days at a temperature from or from about 32° C. to 40° C. or is stable for at least 3 hours under agitation. In another example, the stable co-formulations are formulated such that the purity or potency of insulin is at least 91%, 92%, 93%, 94%, 95%, 96%, 97%, 98%, 99% or more for at least 3 days at a temperature from or from about 32° C. to 40° C. or is stable for at least 3 hours under agitation.

In some embodiments, the pH of the stable co-formulations provided herein is or is about 6.3±0.2, 6.4±0.2, 6.5±0.2, 6.6±0.2, 6.7±0.2, 6.8±0.2, 6.9±0.2, 7.0±0.2, 7.1±0.2, 7.2±0.2, 7.3±0.2, 7.4±0.2 or 7.5±0.2. In other embodiments, the NaCl concentration of the stable co-formulation compositions is between or about between 150 mM to 200 mM or 160 mM to 180 mM. For example, the NaCl concentration is or is about 120 mM, 130 mM, 140 mM, 150 mM, 155 mM, 160 mM, 165 mM, 170 mM, 175 mM, 180 mM, 185 mM, 190 mM, 195 mM or 200 mM. In some embodiments, the stable co-formulation is stable at or about 37° C. for at least 3 days. In other embodiments, the stable co-formulation is stable for at least 4 days, at least 5 days or at least 6 days. In some embodiments, the stable co-formulations contain a sufficient amount of a buffering agent to maintain the pH range of between or about between 6.5 to 7.5.

Hyaluronan degrading enzymes contained in the stable co-formulation compositions provided herein include, for example, hyaluronidases, such as animal, including human, hyaluronidases, particularly soluble forms thereof, and/or chondroitinases. Exemplary hyaluronan degrading enzymes are hyaluronidases and/or chondroitinases. In some embodiments, the hyaluronan-degrading enzyme is a hyaluronidase that is active at neutral pH. In other embodiments, the hyaluronan-degrading enzyme lacks a glycosylphosphatidylinositol (GPI) anchor or is not membrane-associated when expressed from a cell. For example, the hyaluronan-degrading enzyme contains C-terminal truncations of one or more amino acid residues to remove all or part of a GPI anchor. In some examples, the hyaluronan-degrading enzyme in the stable co-formulations provided herein is a hyaluronidase that is a PH20. Exemplary of PH20 hyaluronidases are non-human or human PH20 hyaluronidases. Included are PH20 hyaluronidases that have a sequence of amino acids that contains at least amino acids 36-464 of SEQ ID NO:1, or have a sequence of amino acids that has at least 85% sequence identity to a sequence of amino acids that contains at least amino acids 36-464 of SEQ ID NO:1 and retains hyaluronidase activity. For example, the PH20 has at least 86%, 87%, 88%, 89%, 90%, 91%, 92%, 93%, 94%, 95%, 96%, 97%, 98% or 99% sequence identity to a sequence of amino acids that contains at least amino acids 36-464 of SEQ ID NO:1 and retains hyaluronidase activity. Included are PH20 polypeptides that have a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1. Variants include PH20 polypeptides that that exhibit at least 85% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retain hyaluronidase activity. In some examples, the PH20 in the stable co-formulations provided herein has at least 86%, 87%, 88%, 89%, 90%, 91%, 92%, 93%, 94%, 95%, 96%, 97%, 98% or 99% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity. In some embodiments, the hyaluronan-degrading enzyme is a truncated PH20 that is a C-terminal truncated PH20 polypeptide that includes any from among polypeptides having a sequence of amino acids set forth in any of SEQ ID NOS:4-9, or allelic variants and other variants thereof.

In some embodiments, the amount of PH20 in the stable co-formulations provided herein is between or about between 0.1 µg/mL to 100 µg/mL, 1 µg/mL to 50 µg/mL or 1 µg/mL to 20 µg/mL. For example, the amount of PH20 is or is about 5 µg/mL. In other embodiments, the specific activity of the PH20 is or is between 75 Units (U)/µg to 120 U/µg or is at least, about or is 75 Units (U)/µg, 80 U/µg, 85 U/µg, 90 U/µg, 100 U/µg, 110 U/µg or 120 U/µg. The amount of a hyaluronan-degrading enzyme in the stable co-formulations provided herein is between or about between 10 U/mL to 5000 U/mL, 50 U/mL to 4000 U/mL, 100 U/mL to 2000 U/mL, 300 U/mL to 2000 U/mL, 600 U/mL to 2000 U/mL, or 100 U/mL to 1000 U/mL. For example, the amount of a hyaluronan-degrading enzyme is at least or is about or is 30 U/mL, 35 U/mL, 40 U/mL, 50 U/mL, 100 U/mL, 150 U/mL, 200 U/mL, 250 U/mL, 300 U/mL, 350 U/mL, 400 U/mL, 450 U/mL, 500 U/mL, 600 U/mL, 700 U/mL, 800 U/mL, 900 U/mL, 1000 U/mL or 2000 U/mL. In an exemplary stable co-formulation, the amount of a hyaluronan-degrading enzyme is or is about 600 U/mL.

The fast-acting insulin can be, for example, monomeric or multimeric, such as dimeric or hexameric. In one embodiment, the fast-acting insulin is a fast-acting human insulin. In another embodiment, the fast-acting insulin is a regular insulin, for example, a human insulin or pig insulin. In one example, the fast-acting insulin is a regular insulin and the NaCl concentration of the stable co-formulation provided herein is 50 mM to 80 mM. Among the fast-acting insulins are regular insulins, such as, an insulin with an A chain having a sequence of amino acids set forth in SEQ ID NO:103 and a B chain having a sequence of amino acids set forth in SEQ ID NO:104 or an insulin with an A chain with a sequence of amino acids set forth as amino acid residue positions 88-108 of SEQ ID NO:123 and a B chain with a sequence of amino acids set forth as amino acid residue positions 25-54 of SEQ ID NO:123. The insulin can be recombinant insulin or can be synthesized or partially-synthesized or can be isolated from a natural source. The fast-acting insulin can be an insulin analog. Exemplary of insulin analogs is an insulin analog selected from among an insulin having an A chain with a sequence of amino acids set forth in SEQ ID NO:103 and a B chain having a sequence of amino acids set forth in any of SEQ ID NO:147-149. In some exemplary stable co-formulations provided herein, the fast acting insulin is an insulin aspart having a sequence of amino acids set forth in SEQ ID NO:103 (A-chain) and SEQ ID NO:147 (B-chain) and the NaCl concentration is between or is about between 80 mM to 160 mM. In other exemplary stable co-formulations provided herein, the fast acting insulin is an insulin glulisine having a sequence of amino acids set forth in SEQ ID NO:103 (A-chain) and SEQ ID NO:149 (B-chain) and the NaCl concentration is between or is about between 80 mM to 200 mM. In yet another exemplary stable co-formulation provided herein, the fast acting insulin is an insulin lispro having a sequence of amino acids set forth in SEQ ID NO 103 (A-chain) and SEQ ID NO:148 (B-chain) and the NaCl concentration is between or about between 50 mM to 120 mM.

In some embodiments, the insulin in the stable co-formulation provided herein is in amount that is 10 U/mL to 1000 U/mL, 50 U/mL to 500 U/mL, 100 U/mL to 1000 U/mL or 500 U/mL to 1000 U/mL, inclusive. For example, the amount of fast-acting insulin is at least or is about or is 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 500 U/mL or 1000 U/mL. In an exemplary stable co-formulation, the amount of fast-acting insulin is or is about 100 U/mL. In another exemplary stable co-formulation, the fast-acting insulin is an insulin analog and the hyaluronan-degrading enzyme is a PH20.

The stable co-formulations provided herein optionally include a buffering agent, such as, but not limited to, a non-metal binding agent or a metal binding agent. In some examples, the buffering agent is selected from among Tris, histidine, phosphate or citrate. In an exemplary stable co-formulation, the buffering agent is Tris. The concentration of the buffering agent is between or is between about 1 mM to 100 mM, 10 mM to 50 mM or 20 mM to 40 mM. For example, the concentration of the buffering agent is or is about or is at least 1 mM, 5 mM, 10 mM, 15 mM, 20 mM, 21 mM, 22 mM, 23 mM, 24 mM, 25 mM, 26 mM, 27 mM, 28 mM, 29 mM, 30 mM, 31 mM, 32 mM, 33 mM, 34 mM, 35 mM, 36 mM, 37 mM, 38 mM, 39 mM, 40 mM, 45 mM, 50 mM, 55 mM, 60 mM, 65 mM, 70 mM, 75 mM or more. In an exemplary stable co-formulation, the concentration of buffering agent is or is about 30 mM.

The stable co-formulation compositions provided herein include an anti-microbial effective amount of the preservative that kills or inhibits the propagation of microbial organisms in a sample of the composition such that at least a 1.0 $\log_{10}$ unit reduction in bacterial organisms occurs at 7 days following inoculation. In some examples, the anti-microbial effective amount of the preservative kills or inhibits the propagation of microbial organisms such that, when tested in an antimicrobial preservative effectiveness test (APET), following inoculation of the composition with a microbial inoculum there is at least a 1.0 $\log_{10}$ unit reduction in bacterial organisms at 7 days following inoculation, at least a 3.0 $\log_{10}$ unit reduction of bacterial organisms at 14 days following inoculation, at least no further increase in bacterial organisms after 28 days following inoculation, and at least no increase in fungal organisms after 7 days following inoculation. In other examples, the anti-microbial effective amount of the preservative kills or inhibits the propagation of microbial organisms such that, when tested in an antimicrobial preservative effectiveness test (APET), following inoculation of the composition with a microbial inoculum there is at least a 1.0 $\log_{10}$ unit reduction of bacterial organisms at 24 hours following inoculation, at least a 3.0 $\log_{10}$ unit reduction of bacterial organisms at 7 days following inoculation, no further increase in bacterial organisms after 28 days following inoculation, at least a 1.0 $\log_{10}$ unit reduction of fungal organisms at 14 days following inoculation, and at least no further increase in fungal organisms after 28 days following inoculation. In yet another example, the anti-microbial effective amount of the preservative kills or inhibits the propagation of microbial organisms such that, when tested in an antimicrobial preservative effectiveness test (APET), following inoculation of the composition with a microbial inoculum there is at least a 2.0 $\log_{10}$ unit reduction of bacterial organisms at 6 hours following inoculation, at least a 3.0 $\log_{10}$ unit reduction of bacterial organisms at 24 hours following inoculation, no recovery of bacterial organisms after 28 days following inoculation of the composition with the microbial inoculum, at least a 2.0 $\log_{10}$ unit reduction of fungal organisms at 7 days following inoculation, and at least no further increase in fungal organisms after 28 days following inoculation.

The preservative(s) in the stable co-formulations can include one or more of a phenolic preservative(s), a non-phenolic preservative(s) or a phenolic preservative(s) and a non-phenolic preservative(s). For example, the preservative(s) is(are) selected from among, but not limited to, phenol, m-cresol, methylparaben, benzyl alcohol, thimerosal, benzalkonium chloride, 4-chloro-1-butanol, chlorhexidine dihydrochloride, chlorhexidine digluconate, L-phenylalanine, EDTA, bronopol, phenylmercuric acetate, glycerol, imidurea, chlorhexidine, sodium dehydroacetate, o-cresol, p-cresol, chlorocresol, cetrimide, benzethonium chloride, ethylparaben, propylparaben, butylparaben and any combinations thereof. In some examples, the stable co-formulation contains a single preservative. In other examples, the stable co-formulation contains a mixture of preservatives that contains 2, 3 or 4 different preservatives. In some embodiments, the stable co-formulations contain at least one phenolic preservative. In a particular embodiment, the one or more preservative(s) is(are) phenol, m-cresol or phenol and m-cresol.

The total amount of the one or more preservative agents as a percentage (%) of mass concentration (w/v) in the stable co-formulations provided herein is or is between 0.1% and 0.4%, 0.1% to 0.3%, 0.15% to 0.325%, 0.15% to 0.25%, 0.1% to 0.2%, 0.2% to 0.3% or 0.3% to 0.4% inclusive. In some examples, the preservatives are phenol and m-cresol and the amount as a % of mass concentration (w/v) in the formulation is between or about between 0.1% to 0.25% phenol and between or about between 0.05% to 0.2% m-cresol, is between or about between 0.10% to 0.2% phenol and between or about between 0.6% to 01.8% m-cresol, between or about between 0.1% to 0.15% phenol and 0.8% to 0.15% m-cresol, is between or about between 0.10% to 0.15% phenol and between or about between 0.06 to 0.09% m-cresol or is between or about between 0.12% to 0.18% phenol and between or about between 0.14 to 0.22% m-cresol. In exemplary co-formulations, the preservative(s) are phenol and m-cresol and the amount as a % of mass concentration (w/v) in the formulation is or is about 0.1% phenol and 0.075% m-cresol, is or is about 0.1% phenol and 0.15% m-cresol, is or is about 0.125% phenol and 0.075% m-cresol, is or is about 0.13% phenol and 0.075% m-cresol, is or is about 0.13% phenol and 0.08% m-cresol, is or is about 0.15% phenol and 0.175% m-cresol or is or is about 0.17% phenol and 0.13% m-cresol.

The stable co-formulations provided herein contain a stabilizing agent that is selected from among, but not limited to, an amino acid, amino acid derivative, amine, sugar, polyols, salt or surfactant. In some examples, the stable co-formulations contain a single stabilizing agent. In other examples, the stable co-formulations contain 2, 3, 4, 5 or 6 different stabilizing agents. In some examples, the stabilizing agent is an amino acid, amino acid derivative or amine that is selected from among L-Arginine, glutamine, glutamic acid, glycine, lysine, methionine, proline, Lys-Lys, Gly-Gly, Trimethylamine oxide (TMAO), betaine or salts thereof. In a particular example, the amino acid is glycine or proline. The concentration of the amino acid is between or between about 0.01 M to 1 M, 0.01 M to 0.1 M, 0.1 M to 0.75 M or 0.2 M to 0.5 M, inclusive. In some examples, the stabilizing agent is a sugar or polyol that is selected from among, but not limited to, glycerol, sorbitol, mannitol, inositol, sucrose and trehalose.

In an exemplary stable co-formulation, the stabilizing agent is a surfactant and the amount of surfactant as a % of mass concentration (w/v) in the formulation is between or about between 0.005% to 1.0%, 0.01% to 0.5%, 0.01% to 0.1%, 0.01% to 0.05%, or 0.01% to 0.02%. For example, the stabilizing agent is a surfactant and the amount of surfactant as a % of mass concentration (w/v) in the formulation is or is about 0.001%, 0.005%, 0.01%, 0.015%, 0.02%, 0.025%, 0.03%, 0.035%, 0.04%, 0.045%, 0.05%, 0.055%, 0.06%, 0.065%, 0.07%, 0.08% or 0.9%. The surfactant in the stable co-formulations provided herein can be selected from among, but not limited to, a polypropylene glycol, polyethylene glycol, glycerin, sorbitol, poloxamer and polysorbate. For example, the surfactant is selected from among poloxamer 188, polysorbate 20 or polysorbate 80. In an exemplary stable co-formulation, the stabilizing agent is a surfactant that is poloxamer 188 and is provided in an amount as a % of mass concentration (w/v) of between or about between 0.01% to 0.05%. In another exemplary stable co-formulation, the stabilizing agent is a surfactant that is polysorbate 20 and is provided in an amount as a % of mass concentration (w/v) of between or about between 0.01% to 0.05%. In yet another exemplary stable co-formulation, the stabilizing agent is a surfactant that is polysorbate 80 and is provided in an amount as a % of mass concentration (w/v) of between or about between 0.01% to 0.05%.

The stable co-formulations provided herein optionally include a tonicity modifier, that is selected from among, but not limited to, glycerin, salt, amino acids, polyalcohols or trehalose, to maintain the osmolality of between or about between 245 mOsm/kg to 305 mOsm/kg. In some examples, the tonicity modifier maintains the osmolality of the formulation of about or at 245 mOsm/kg, 250 mOsm/kg, 255 mOsm/kg, 260 mOsm/kg, 265 mOsm/kg, 270 mOsm/kg, 275 mOsm/kg, 280 mOsm/kg, 285 mOsm/kg, 290 mOsm/kg, 300 mOsm/kg or 305 mOsm/kg. In an exemplary stable co-formulation, the tonicity modifier maintains the osmolality of the formulation of or of about 275 mOsm/kg. In one embodiment, the tonicity modifier is glycerin that is present in the co-formulation at a concentration less than 60 mM, less than 55 mM, less than 50 mM, less than 45 mM, less than 40 mM, less than 35 mM, less than 30 mM, less than 25 mM, less than 20 mM, less than 15 mM, or less than 10 mM. In an exemplary stable co-formulation, the fast-acting insulin is an insulin analog that is insulin aspart and the formulation contains glycerin in a concentration between or about between 20 mM to 50 mM, inclusive. In another exemplary stable co-formulation, the fast acting insulin is a regular insulin or is insulin lispro and the formulation comprises glycerin in a concentration between or about between 40 mM to 60 mM, inclusive.

In some embodiments, the stable co-formulations provided herein optionally contain an antioxidant. In other embodiments, the stable co-formulations provided herein optionally contain a surfactant and/or hyaluronan oligosaccharides, and also contain an antioxidant. The antioxidant included in the stable co-formulations provided herein is selected from among, but not limited to, cysteine, tryptophan and methionine. In an exemplary stable co-formulation, the antioxidant is methionine. The antioxidant in the stable co-formulations is at a concentration from between or from about between 5 mM to 50 mM, 5 mM to 40 mM, 5 mM to 20 mM or 10 mM to 20 mM, inclusive. In an exemplary embodiment, the antioxidant is methionine and the concentration of methionine is between or about between 10 mM to 20 mM.

The stable co-formulations provided herein optionally contain zinc. For example, in one embodiment, the fast-acting insulin is regular insulin, insulin lispro or insulin aspart and the formulation contains zinc. The zinc in the stable co-formulations is selected from among, but not limited to, zinc oxide, zinc acetate or zinc chloride, and is present at a concentration of between or about between 0.001 to 0.1 mg per 100 units of insulin (mg/100 U), 0.001 to 0.05 mg/100 U or 0.01 to 0.05 mg/100 U.

The stable co-formulations provided herein optionally contain a nicotinic compound, that is selected from among, but not limited to, nicotinamide, nicotinic acid, niacin, niacinamide, vitamin B3 and/or salts thereof and/or any combination thereof. The nicotinic compound(s) are present in a concentration from or from about 1 mm to 150 mM, 10 mM to 150 mM, 50 mM to 100 mM or of or of about 80 mM.

The stable co-formulations provided herein optionally contain one or more amino acid(s), selected from among, but not limited to, arginine, glutamic acid, and/or salts thereof and/or combinations thereof. The amino acids are present at a concentration of 1 to 100 mM, 10 to 100 mM, or of or of about 30 mM, 50 mM or 80 mM.

An exemplary stable co-formulation provided herein has a pH of between or about between 7.0 to 7.6, and contains a hyaluronan-degrading enzyme that is a PH20 in an amount between or about between 100 U/mL to 1000 U/mL, inclusive; a fast-acting insulin analog in an amount between or about between 10 U/mL to 1000 U/mL, inclusive; a Tris buffering agent at a concentration of between or about between 10 mM to 50 mM, inclusive; NaCl at a concentration of between or about between 50 to 200 mM, inclusive; methionine at a concentration between or about between 5 mM to 50 mM, inclusive; glycerin at a concentration from between or about between 0 mM to 50 mM, inclusive; a surfactant that is poloxamer 188, polysorbate 20 or polysorbate 80 at a percentage (%) of mass concentration (w/v) of between or about between 0.01% to 0.5%; and a preservative(s) that contains phenol at a percentage (%) of mass concentration (w/v) of between or about between 0.1% to 0.25% and m-cresol at a % w/v of between or between about 0.05% to 0.2%. In another embodiment, this exemplary stable co-formulation further contains zinc at a concentration of 0.001 to 0.1 mg per 100 units of insulin (mg/100U). In one embodiment, the preservatives in the stable co-formulations are or are about 0.1% phenol and 0.015% m-cresol, 0.125% phenol and 0.075% m-cresol, 0.13% phenol and 0.075% m-cresol, 0.13% phenol and 0.08% m-cresol or 0.17% phenol and 0.13% m-cresol.

An exemplary stable co-formulation provided herein has a pH between or about between 7.0 to 7.6 and contains a fast-acting insulin that is insulin lispro in an amount between or about between 10 U/mL to 1000 U/mL, inclusive; a hyaluronan-degrading enzyme that is a PH20 in an amount between or about between 100 U/mL to 1000 U/mL, inclusive; a Tris buffering agent at a concentration of between or about between 25 mM to 35 mM, inclusive; NaCl at a concentration of between or about between 50 mM to 120 mM, inclusive; methionine at a concentration between or about between 10 mM to 30 mM, inclusive; glycerin at a concentration from between or about between 40 mM to 60 mM, inclusive; a surfactant that is poloxamer 188, polysorbate 20 or polysorbate 80 at a percentage (%) of mass concentration (w/v) of between or about between 0.01% to 0.05%, inclusive; zinc at a concentration of 0.017 to 0.024 mg per 100 units of insulin (mg/100 U); and a preservative(s) that contains a percentage (%) of mass concentration (w/v) of between or about between 0.08% to 0.17% phenol, inclusive, and between or about between 0.07% to 0.17% m-cresol. In one embodiment, the NaCl concentration is between or about between 70 mM to 100 mM. In another embodiment, the pH is or is about 7.1±0.2, 7.2±0.2, 7.3±0.2 or 7.4±0.2. In one embodiment, the preservatives in the stable co-formulations are or are about 0.1% phenol and 0.015% m-cresol, 0.125% phenol and 0.075% m-cresol, 0.13% phenol and 0.075% m-cresol, 0.13% phenol and 0.08% m-cresol or 0.17% phenol and 0.13% m-cresol.

An exemplary stable co-formulation provided herein has a pH between or about between 7.0 to 7.6 and contains a fast-acting insulin that is insulin aspart in an amount between or about between 10 U/mL to 1000 U/mL, inclusive; a hyaluronan-degrading enzyme that is a PH20 in an amount between or about between 100 U/mL to 1000 U/mL, inclusive; a Tris buffering agent at a concentration of between or about between 25 mM to 35 mM, inclusive; NaCl at a concentration of between or about between 80 mM to 160 mM, inclusive; methionine at a concentration between or about between 10 mM to 30 mM, inclusive; glycerin at a concentration from between or about between 20 mM to 50 mM, inclusive; a surfactant that is poloxamer 188, polysorbate 20 or polysorbate 80 at a percentage (%) of mass concentration (w/v) of between or about between 0.01% to 0.05%, inclusive; zinc at a concentration of 0.017 to 0.024 mg per 100 units of insulin (mg/100 U); and a preservative(s) that contains a percentage (%) of mass concentration (w/v) of between or about between 0.08% to 0.17% phenol, inclusive, and between or about between 0.07% to 0.17% m-cresol. In one embodiment, the NaCl concentration is or is about between 70 mM to 100 mM. In another embodiment, the pH is or is about 7.2±0.2, 7.3±0.2, 7.4±0.2 or 7.5±0.2. In one embodiment, the preservatives in the stable co-formulations are or are about 0.1% phenol and 0.015% m-cresol, 0.125% phenol and 0.075% m-cresol, 0.13% phenol and 0.075% m-cresol, 0.13% phenol and 0.08% m-cresol or 0.17% phenol and 0.13% m-cresol.

An exemplary stable co-formulation provided herein has a pH between or about between 7.0 to 7.6 and contains a fast-acting insulin that is insulin glulisine in an amount between or about between 10 U/mL to 1000 U/mL, inclusive; a hyaluronan-degrading enzyme that is a PH20 in an amount between or about between 100 U/mL to 1000 U/mL, inclusive; a Tris buffering agent at a concentration of between or about between 25 mM to 35 mM, inclusive; NaCl at a concentration of between or about between 80 mM to 200 mM, inclusive; methionine at a concentration between or about between 10 mM to 30 mM, inclusive; glycerin at a concentration from between or about between 40 mM to 60 mM, inclusive; a surfactant that is poloxamer 188 at a percentage (%) of mass concentration (w/v) of between or about between 0.01% to 0.05%, inclusive; and a preservative(s) that has a percentage (%) of mass concentration (w/v) of between or about between 0.08% to 0.17% phenol, inclusive, and between or about between 0.07% to 0.17% m-cresol. In one embodiment, the NaCl concentration is between or about between 100 mM to 150 mM. In another embodiment, the pH is or is about 7.2±0.2, 7.3±0.2, 7.4±0.2 or 7.5±0.2.

In one embodiment, the PH20 in the stable co-formulations provided herein is a human PH20 that has a sequence of amino acids that contains at least amino acids 36-464 of SEQ ID NO:1, or has a sequence of amino acids that has at least 85%, 90% or 95% sequence identity to a sequence of amino acids that contains at least amino acids 36-464 of SEQ ID NO:1 and retains hyaluronidase activity. For example, the PH20 polypeptide has a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1, or is a variant thereof that exhibits at least 85%, 90% or 95% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity. In another example, the PH20 polypeptide has a sequence of amino acids that contains a C-terminal truncation after amino acid position 482 of the sequence of amino acids set forth in SEQ ID NO:1, or is a variant thereof that exhibits at least 85%, 90% or 95% sequence identity to a sequence of amino acids that contains a C-terminal truncation after amino acid position 482 of the sequence of amino acids set forth in SEQ ID NO:1 and retains hyaluronidase activity. In an exemplary stable co-formulation, the PH20 polypeptide has a sequence of amino acids set forth in any of SEQ ID NOS: 4-9. The hyaluronan-degrading enzyme or PH20 in the stable co-formulations provided herein can be produced and expressed from mammalian cells, for example, Chinese Hamster Ovary (CHO) cells. In a particular example, the PH20 is designated rHuPH20.

The stable co-formulations provided herein can be formulated for multi-dose administration. The volume of the stable co-formulations can be between or about between 0.5 mL to 50 mL, 1 mL to 40 mL, 1 mL to 20 mL, 1 mL to 10 mL, or 3 mL to 10 mL, inclusive. The stable co-formulations provided herein can be formulated for delivery using a vial, syringe, pen, reservoir for a pump or a closed loop system. In a particular example, the stable co-formulations are formulated for delivery using a continuous subcutaneous insulin infusion, that is provided by a closed loop system.

The stable co-formulations provided herein can be provided in syringes or vials, a closed loop system, an insulin pump, and/or an insulin pen.

Provided are methods in which the stable co-formulations are administered. For example, provided herein are methods of treating diabetes by administering to a subject a therapeutically effective amount of a stable co-formulation provided herein. The diabetes to be treated includes type 1 diabetes mellitus, type 2 diabetes mellitus or gestational diabetes. Also provided herein are methods for controlling blood glucose levels in a subject by administering to a subject a therapeutically effective amount of a stable co-formulation provided herein. In practicing the methods herein, the stable co-formulations are administered subcutaneously or intraperitoneally, for example, via a syringe or insulin pen or by continuous subcutaneous infusion. In practicing the methods herein, the stable co-formulations can be administered prior to a meal as prandial insulin therapy. In the methods provided herein, the stable co-formulation can be administered using a delivery method to achieve continuous subcutaneous insulin infusion, such as via an insulin pump or a closed loop system. In some instances, the methods provided herein include administering another anti-diabetic drug, that is selected from among, but not limited to, sulfonylureas, biguanides, meglitinides, thiazolidinediones, alpha-glucosidase inhibitors, peptide analogs, including glucagon-like peptide (GLP) analogs and, gastric inhibitory peptide (GIP) analogs and DPP-4 inhibitors.

Also provided herein are compositions containing a therapeutically effective amount of a hyaluronan-degrading enzyme and lysyl lysine (Lys-Lys) in an amount to render the hyaluronan-degrading enzyme stable. In some examples, the concentration of Lys-Lys is between or about between 5 mM to 120 mM, 10 mM to 100 mM, 10 mM to 50 mM, 30 mM to 110 mM, 30 mM to 80 mM, 50 mM to 100 mM or 100 mM to 120 mM. In other examples, the concentration of Lys-Lys is at least or at least about or is 5 mM, 10 mM, 15 mM, 20 mM, 30 mM, 40 mM, 50 mM, 60 mM, 70 mM, 80 mM, 90 mM, 100 mM, 110 mM or 120 mM. Provided herein are compositions containing a therapeutically effective amount of a hyaluronan-degrading enzyme and lysyl lysine (Lys-Lys) in an amount sufficient such that the hyaluronan-degrading enzyme retains at least 50% of the initial hyaluronidase activity for at least three (3) days at 37° C. In some examples, the hyaluronan-degrading enzyme retains at least 50% of the initial hyaluronidase activity at 37° C. for at least 4 days, 5 days, 6 days, one week, two weeks, three weeks, one month, two months, three months four months, five months, six months or more. In a particular example, the hyaluronan-degrading enzyme retains at least 50% of the initial hyaluronidase activity for at least one month at 37° C. In other examples, the hyaluronan-degrading enzyme retains at least 60%, 70%, 75%, 80%, 85%, 90%, 95% or more of the initial hyaluronidase activity.

In some examples of the provided compositions, the pH of the formulation is between or about between 6.5 to 8.0, 6.5 to 7.4, 6.8 to 7.8, 7.0 to 7.6 or 6.8 to 7.2, inclusive. For example, the pH of the formulation is or is about or at least 6.5±0.2, 6.6±0.2, 6.7±0.2, 6.8±0.2, 6.9±0.2, 7.0±0.2, 7.1±0.2, 7.2±0.2, 7.3±0.2, 7.4±0.2, 7.5±0.2, 7.6±0.2, 7.7±0.2 or 7.8±0.2.

Any of the provided compositions containing a therapeutically effective amount of a hyaluronan-degrading enzyme and lysyl lysine (Lys-Lys) can further contain a stabilizing agent. For example, the compositions can contain a stabilizing agent that is selected from among an amino acid, an amino acid derivative, an amine, a sugar, a polyol, a salt and a surfactant. In some examples, the stabilizing agent is a surfactant and the amount of surfactant, as a % of mass concentration (w/v) in the formulation, is between or about between 0.0005% to 1.0%, 0.0005% to 0.005%, 0.001% to 0.01%, 0.01% to 0.5%, 0.01% to 0.1%, 0.01% to 0.05%, or 0.01% to 0.02%, inclusive. In other examples, the stabilizing agent is a surfactant and the amount of surfactant, as a % of mass concentration (w/v) in the formulation, is or is about or at least 0.001%, 0.005%, 0.01%, 0.015%, 0.02%, 0.025%, 0.03%, 0.035%, 0.04%, 0.045%, 0.05%, 0.055%, 0.06%, 0.065%, 0.07%, 0.08% or 0.9%. The surfactant can be selected from among a polypropylene glycol, polyethylene glycol, glycerin, sorbitol, poloxamer and polysorbate. In a particular example, the surfactant is selected from among poloxamer 188, polysorbate 20 and polysorbate 80.

In some examples, the provided compositions containing a therapeutically effective amount of a hyaluronan-degrading enzyme and lysyl lysine (Lys-Lys) also contain an antioxidant. For example, the compositions contain an antioxidant that is selected from among cysteine, tryptophan and methionine. In a particular example, the antioxidant is methionine. In some examples, the antioxidant is present at a concentration from between or from about between 5 mM to 50 mM, 5 mM to 40 mM, 5 mM to 20 mM or 10 mM to 20 mM, inclusive. In other examples, the antioxidant is present at a concentration that is or is about or is at least 5 mM, 10 mM, 15 mM, 20 mM, 30 mM, 40 mM or 50 mM.

In some examples, the provided compositions containing a therapeutically effective amount of a hyaluronan-degrading enzyme and lysyl lysine (Lys-Lys) also contain a tonicity modifier to maintain the osmolality of between or about between 245 mOsm/kg to 500 mOsm/kg, inclusive. In some examples, the compositions contain a tonicity modifier to maintain the osmolality of the formulation of about or at least about or 245 mOsm/kg, 250 mOsm/kg, 255 mOsm/kg, 260 mOsm/kg, 265 mOsm/kg, 270 mOsm/kg, 275 mOsm/kg, 280 mOsm/kg, 285 mOsm/kg, 290 mOsm/kg, 300 mOsm/kg, 350 mOsm/kg, 400 mOsm/kg, 450 mOsm/kg or 500 mOsm/kg. In some examples, the tonicity modifier is selected from among glycerin, NaCl, amino acids, polyalcohols or trehalose. In a particular example, the tonicity modifier is NaCl and the concentration of NaCl is or is about between 20 mM to 200 mM, 40 mM to 160 mM, 80 mM to 120 mM, 20 mM to 80 mM or 50 mM to 150 mM, inclusive. In other examples, the tonicity modifier is NaCl and the concentration if NaCl is 0 mM to 150 mM, 10 mM to 50 mM, 50 mM to 100 mM and 100 mM to 130 mM. In some example, the NaCl is at a concentration of less than 150 mM, less than 140 mM, less than 130 mM, less than 120 mM, less than 110 mM, less than 100 mM, less than 90 mM, less than 80 mM, less than 70 mM, less than 60 mM, less than 50 mM, less than 40 mM, less than 30 mM, less than 20 mM, less than 10 mM, or less.

Any of the provided compositions containing a therapeutically effective amount of a hyaluronan-degrading enzyme and lysyl lysine (Lys-Lys) can also contain a sufficient amount of a buffering agent to maintain the pH range of between or about between 6.5 to 8.0, 6.8 to 7.8, or 7.0 to 7.6, 6.5 to 7.2, 6.8 to 7.4, inclusive. In some examples, the buffering agent is selected from among Tris, histidine, phosphate and citrate. In a particular example, the buffering agent is a phosphate that is sodium phosphate. In another particular example, the buffering agent is Tris. In some examples, the concentration of the buffering agent in the compositions is between or is between about 1 mM to 100 mM, 10 mM to 80 mM, 5 mM to 50 mM or 20 mM to 40 mM, inclusive.

The hyaluronan-degrading enzyme in any of the provided compositions containing a therapeutically effective amount of a hyaluronan-degrading enzyme and lysyl lysine (Lys-Lys) can be a hyaluronidase or a chondroitinase. In some examples, the hyaluronan-degrading enzyme is a hyaluronidase that is active at neutral pH. In some examples, the hyaluronan-degrading enzyme lacks a glycosylphosphatidylinositol (GPI) anchor or is not membrane-associated when expressed from a cell. In other examples, the hyaluronan-degrading enzyme is a hyaluronan-degrading enzyme that contains C-terminal truncations of one or more amino acid residues to remove all or part of a GPI anchor.

In other examples of the provided compositions, the hyaluronan-degrading enzyme is a hyaluronidase that is a PH20 or a C-terminally truncated fragment thereof. In some examples the hyaluronan-degrading enzyme is a PH20 that is a non-human or a human PH20. In some examples, the PH20 has a sequence of amino acids that contains at least amino acids 36-464 of SEQ ID NO:1, or has a sequence of amino acids that has at least 85% sequence identity to a sequence of amino acids that contains at least amino acids 36-464 of SEQ ID NO:1 and retains hyaluronidase activity. For example, the PH20 has at least 86%, 87%, 88%, 89%, 90%, 91%, 92%, 93%, 94%, 95%, 96%, 97%, 98% or 99% sequence identity to a sequence of amino acids that contains at least amino acids 36-464 of SEQ ID NO:1 and retains hyaluronidase activity. In some examples of the compositions, the hyaluronan-degrading enzyme is a PH20 polypeptide that has a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1, or is a variant thereof that exhibits at least 85% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity. In particular examples, the hyaluronan-degrading enzyme is a C-terminal truncated PH20 that has a sequence of amino set forth in any of SEQ ID NOS: 4-9.

In some examples of the provided compositions, the amount of a hyaluronan-degrading enzyme is between or about between 10 U/mL to 5000 U/mL, 50 U/mL to 4000 U/mL, 100 U/mL to 2000 U/mL, 300 U/mL to 2000 U/mL, 600 U/mL to 2000 U/mL, 100 U/mL to 1000 U/mL, 200 U/mL to 800 U/mL, 100 U/mL to 500 U/mL, or 150 U/mL to 300 U/ml, inclusive. For example, the amount of a hyaluronan-degrading enzyme is at least or is about or is 30 U/mL, 35 U/mL, 40 U/mL, 45 U/mL, 50 U/mL, 55 U/mL, 60 U/mL, 65 U/mL, 70 U/mL, 75 U/mL, 80 U/mL, 85 U/mL, 90 U/mL, 95 U/mL, 100 U/mL, 105 U/mL, 110 U/mL, 115 U/mL, 120 U/mL, 125 U/mL, 130 U/mL, 135 U/mL, 140 U/mL, 145 U/mL, 150 U/mL, 155 U/mL, 160 U/mL, 170 U/mL, 180 U/mL, 190 U/mL, 200 U/mL, 250 U/mL, 300 U/mL, 350 U/mL, 400 U/mL, 450 U/mL, 500 U/mL, 600 U/mL, 700 U/mL, 800 U/mL, 900 U/mL, 1000 U/mL or 2000 U/mL.

In some examples of the compositions containing a therapeutically effective amount of a hyaluronan-degrading enzyme and lysyl lysine (Lys-Lys), the concentration of Lys-Lys is 5 mM to 50 mM, inclusive. For example, the concentration of Lys-Lys is at least 5 mM, 10 mM, 15 mM, 20 mM, 30 mM or 50 mM; and/or is less than 50 mM, 40 mM, 30 mM, 20 mM or 10 mM.

Provided herein are compositions containing a therapeutically effective amount of a hyaluronan-degrading enzyme and lysyl lysine (Lys-Lys) wherein the pH of the composition is between or about between 6.5 to 7.2 and the composition contains a hyaluronan-degrading enzyme in an amount that is between or about between 100 U/mL to 500 U/mL, inclusive; Lys-Lys at a concentration that is between or about between 5 mM to 30 mM, inclusive; NaCl at a concentration less than 140 mM NaCl; a surfactant that is polysorbate 80 at a percentage (%) of mass concentration (w/v) of between or about between 0.01% to 0.05%, inclusive; methionine at a concentration that is between or about between 5 mM to 20 mM, inclusive; and sodium phosphate at a concentration that is between or about between 5 mM to 50 mM, inclusive. In some examples, the hyaluronan-degrading enzyme is a PH20 or a C-terminally truncated fragment thereof.

In some examples, the volume of the provided compositions is between or about between 0.5 mL to 50 mL, 1 mL to 40 mL, 1 mL to 20 mL, 1 mL to 10 mL, or 3 mL to 10 mL, inclusive. The compositions can be formulated for delivery using a vial, syringe, pen, reservoir for a pump or a closed loop system. Also provided herein is a syringe or vial containing any of the compositions provided herein.

Also provided herein are compositions containing a therapeutically effective amount of a hyaluronan-degrading enzyme, lysyl lysine (Lys-Lys) in an amount to render the hyaluronan-degrading enzyme stable and a fast-acting insulin. In some examples, the concentration of Lys-Lys is 30 mM to 120 mM, 50 mM to 105 mM or 80 mM to 100 mM, inclusive. In the provided compositions, the fast-acting insulin can be monomeric, dimeric or hexameric. In some examples, the fast-acting insulin is a fast-acting human insulin. In other examples, the fast-acting insulin is a regular insulin. In a particular example, the fast-acting insulin is a regular insulin that is a human insulin or pig insulin. In some examples, the fast-acting insulin is a regular insulin which is an insulin with an A chain having a sequence of amino acids set forth in SEQ ID NO:103 and a B chain having a sequence of amino acids set forth in SEQ ID NO:104 or an insulin with an A chain with a sequence of amino acids set forth as amino acid residue positions 88-108 of SEQ ID NO:123 and a B chain with a sequence of amino acids set forth as amino acid residue positions 25-54 of SEQ ID NO:123. In yet other examples of the provided compositions, the fast-acting insulin is a recombinant insulin. The fast-acting insulin can be synthesized or partially-synthesized. In some examples, the insulin is isolated.

In other examples of the provided compositions, the fast-acting insulin is an insulin analog. In some examples, the insulin analog is selected from among insulin aspart, insulin lispro and insulin glulisine. For example, the insulin analog is selected from among an insulin having an A chain with a sequence of amino acids set forth in SEQ NOS:103 and a B chain having a sequence of amino acids set forth in any of SEQ NOS:147-149. In any of the provided compositions, the fast-acting insulin can be present in an amount between or about between 10 U/mL to 1000 U/mL, 20 U/mL to 500 U/mL, 50 U/mL to 300 U/mL or 200 U/mL to 800 U/mL, inclusive. For example, the amount of fast-acting insulin is at least or is about or is 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 500 U/mL, 600 U/mL, 700 U/mL, 800 U/mL, 900 U/mL or 1000 U/mL.

In particular examples of the provided compositions containing a therapeutically effective amount of a hyaluronan-degrading enzyme, lysyl lysine (Lys-Lys) in an amount to render the hyaluronan:degrading enzyme stable and a fast-acting insulin, the fast-acting insulin is an insulin analog and the hyaluronan-degrading enzyme is a PH20 or a C-terminally truncated fragment thereof. In a particular example, the fast-acting insulin is an insulin analog that is glulisine and the concentration of Lys-Lys is 50 to 105 mM. In another example, the fast-acting insulin is an insulin analog that is insulin aspart or insulin lispro and the concentration of Lys-Lys is 80 to 100 mM.

Any of the compositions containing a therapeutically effective amount of a hyaluronan-degrading enzyme, lysyl lysine (Lys-Lys) in an amount to render the hyaluronan-degrading enzyme stable and a fast-acting insulin provided herein can be for single dosage administration or for multiple dosage administration. In examples where the composition is for multiple dosage administration, the composition contains an anti-microbially effective amount of a preservative or mixture of preservatives. The preservative(s) in the formulation can contain one or more of a phenolic preservative(s), a non-phenolic preservative(s) or a phenolic preservative(s) and a non-phenolic preservative(s). In some examples, the preservative(s) is(are) selected from among phenol, m-cresol, methylparaben, benzyl alcohol, thimerosal, benzalkonium chloride, 4-chloro-1-butanol, chlorhexidine dihydrochloride, chlorhexidine digluconate, L-phenylalanine, EDTA, bronopol, phenylmercuric acetate, glycerol, imidurea, chlorhexidine, sodium dehydroacetate, o-cresol, p-cresol, chlorocresol, cetrimide, benzethonium chloride, ethylparaben, propylparaben, butylparaben and any combinations thereof. In some examples of the provided compositions for multiple dosage administration, the formulation contains a single preservative. In other examples of the provided compositions for multiple dosage administration, the formulation contains a mixture of preservatives that contains 2, 3 or 4 different preservatives. In some examples, the compositions contain at least one phenolic preservative. In other examples, the preservative(s) is(are) phenol, m-cresol or phenol and m-cresol.

In some examples of the provided compositions, the total amount of the one or more preservative agents as a percentage (%) of mass concentration (w/v) in the formulation is or is between 0.1% and 0.4%, 0.1% to 0.3%, 0.15% to 0.325%, 0.15% to 0.25%, 0.1% to 0.2%, 0.2% to 0.3% or 0.3% to 0.4%, inclusive. In particular examples of the provided compositions wherein the preservatives are phenol and m-cresol, the amount as a % of mass concentration (w/v) in the formulation is between or about between 0.1% to 0.25% phenol and between or about between 0.05% to 0.2% m-cresol, is between or about between 0.10% to 0.2% phenol and between or about between 0.06% to 0.18% m-cresol, is between or about between 0.1% to 0.15% phenol and 0.08% to 0.15% m-cresol, is between or about between 0.10% to 0.15% phenol and between or about between 0.06 to 0.09% m-cresol or is between or about between 0.12% to 0.18% phenol and between or about between 0.14 to 0.22% m-cresol, inclusive. In other particular examples of the provided compositions wherein the preservatives are phenol and m-cresol, the amount as a % of mass concentration (w/v) in the formulation is or is about 0.1% phenol and 0.075% m-cresol, is or is about 0.1% phenol and 0.15% m-cresol, is or is about 0.125% phenol and 0.075% m-cresol, is or is about 0.13% phenol and 0.075% m-cresol, is or is about 0.13% phenol and 0.08% m-cresol, is or is about 0.15% phenol and 0.175% m-cresol or is or is about 0.17% phenol and 0.13% m-cresol.

Provided herein are compositions containing a therapeutically effective amount of a hyaluronan-degrading enzyme, lysyl lysine (Lys-Lys) in an amount to render the hyaluronan-degrading enzyme stable and a fast-acting insulin wherein the pH of the composition is between or about between 6.8 to 7.4; and the composition contains a hyaluronan-degrading enzyme that is a PH20 in an amount between or about between 100 U/mL to 1000 U/mL, inclusive; a fast-acting insulin analog that is insulin glulisine is an amount between or about between 10 U/mL to 1000 U/mL, inclusive; Lys-Lys at a concentration between or about between 50 mM to 105 mM, inclusive; NaCl at a concentration of less than 100 mM; a surfactant that is polysorbate 20 at a percentage (%) of mass concentration (w/v) of between or about between 0.0005% to 0.005%, inclusive; methionine at a concentration between or about between 5 mM to 20 mM, inclusive; and a preservative(s) that contains phenol at a percentage (%) of mass concentration (w/v) of between or between-about between 0.1% to 0.25% and m-cresol at a % w/v of between or between about 0.05% to 0.2%.

Provided herein are compositions containing a therapeutically effective amount of a hyaluronan-degrading enzyme, lysyl lysine (Lys-Lys) in an amount to render the hyaluronan-degrading enzyme stable and a fast-acting insulin wherein the pH of the composition is between or about between 6.8 to 7.4; and the composition contains a hyaluronan-degrading enzyme that is a PH20 in an amount between or about between 100 U/mL to 1000 U/mL, inclusive; a fast-acting insulin analog that is insulin aspart or insulin lispro is an amount between or about between 10 U/mL to 1000 U/mL, inclusive; Lys-Lys at a concentration between or about between 80 mM to 100 mM, inclusive; NaCl at a concentration of less than 30 mM; a surfactant that is polysorbate 20 at a percentage (%) of mass concentration (w/v) of between or about between 0.0005% to 0.005%, inclusive; methionine at a concentration between or about between 5 mM to 20 mM, inclusive; and a preservative(s) that contains phenol at a percentage (%) of mass concentration (w/v) of between or between about between 0.1% to 0.25% and m-cresol at a % w/v of between or between about 0.05% to 0.2%.

In some examples, the volume of the provided compositions is between or about between 0.5 mL to 50 mL, 1 mL to 40 mL, 1 mL to 20 mL, 1 mL to 10 mL, or 3 mL to 10 mL, inclusive. The compositions can be formulated for delivery using a vial, syringe, pen, reservoir for a pump or a closed loop system. In some examples, the compositions are formulated for delivery using a continuous subcutaneous insulin infusion. Also provided herein is a syringe or vial containing any of the compositions provided herein.

Provided herein are compositions containing a therapeutically effective amount of a hyaluronan-degrading enzyme and $MgCl_2$ in a sufficient amount such that the hyaluronan-degrading enzyme retains at least 50% of the initial hyaluronidase activity for at least three (3) days at 37° C. In some examples, the compositions contain $MgCl_2$ at a concentration that is between or about between 50 mM to 150 mM, 75 mM to 125 mM or 80 mM to 100 mM, inclusive. For example, the compositions contain $MgCl_2$ at a concentration that is at least or is about or is 50 mM, 60 mM, 70 mM, 80 mM, 90 mM, 100 mM, 110 mM, 120 mM, 130 mM, 140 mM or 150 mM. In some examples of the compositions, the hyaluronan-degrading enzyme retains at least 50% of the initial hyaluronidase activity at 37° C. for at least 4 days, 5 days, 6 days, one week, two weeks, three weeks, one month, two months, three months, four months, five months, six months or more. For example, the hyaluronan-degrading enzyme retains at least 50% of the initial hyaluronidase activity for at least one month at 37° C., such as at least 60%, 70%, 75%, 80%, 85%, 90%, 95% or more of the initial hyaluronidase activity.

The provided compositions containing a therapeutically effective amount of a hyaluronan-degrading enzyme and $MgCl_2$ can have a pH that is between or about between 6.5 to 8.0, 6.5 to 7.4, 6.8 to 7.8, 7.0 to 7.6 or 6.8 to 7.2. In some examples, the pH of the composition is or is about or at least 6.5±0.2, 6.6±0.2, 6.7±0.2, 6.8±0.2, 6.9±0.2, 7.0±0.2, 7.1±0.2, 7.2±0.2, 7.3±0.2, 7.4±0.2, 7.5±0.2, 7.6±0.2, 7.7±0.2 or 7.8±0.2. The compositions can further contain a stabilizing agent that is selected from among an amino acid, an amino acid derivative, an amine, a sugar, a polyol, a salt and a surfactant. In some examples, the stabilizing agent is a surfactant and the amount of surfactant, as a % of mass concentration (w/v) in the formulation, is between or about between 0.0005% to 1.0%, 0.0005% to 0.005%, 0.001% to 0.01%, 0.01% to 0.5%, 0.01% to 0.1%, 0.01% to 0.05% or 0.01% to 0.02%, inclusive. For example, the stabilizing agent is a surfactant and the amount of surfactant, as a % of mass concentration (w/v) in the formulation, is or is about or at least 0.001%, 0.005%, 0.01%, 0.015%, 0.02%, 0.025%, 0.03%, 0.035%, 0.04%, 0.045%, 0.05%, 0.055%, 0.06%, 0.065%, 0.07%, 0.08% or 0.9%. In some examples, the surfactant is selected from among a polypropylene glycol, polyethylene glycol, glycerin, sorbitol, poloxamer and polysorbate. In particular examples, the surfactant is selected from among poloxamer 188, polysorbate 20 and polysorbate 80.

In some examples, the provided compositions containing a therapeutically effective amount of a hyaluronan-degrading enzyme and $MgCl_2$ contain an antioxidant that is selected from among cysteine, tryptophan and methionine. In particular examples, the antioxidant is methionine. In some examples, the antioxidant is at a concentration from between or from about between 5 mM to 50 mM, 5 mM to 40 mM, 5 mM to 20 mM or 10 mM to 20 mM, inclusive. For example, the antioxidant is methionine and the concentration is or is about or is at least 5 mM, 10 mM, 15 mM, 20 mM, 30 mM, 40 mM or 50 mM. In some examples, the compositions contain a sufficient amount of a buffering agent to maintain the pH range of between or about between 6.5 to 8.0, 6.8 to 7.8, 7.0 to 7.6, 6.5 to 7.2 or 6.8 to 7.4. In some examples, the buffering agent is selected from among Tris, histidine, phosphate and citrate. In a particular example, the buffering agent is histidine hydrochloride. The concentration of the buffering agent in the provided compositions can be between or between about 1 mM to 100 mM, 10 mM to 80 mM, 5 mM to 50 mM or 20 mM to 40 mM.

In some examples, the provided compositions containing a therapeutically effective amount of a hyaluronan-degrading enzyme and $MgCl_2$ contain a hyaluronan-degrading enzyme is a hyaluronidase or a chondroitinase. In some examples, the hyaluronan-degrading enzyme is a hyaluronidase that is active at neutral pH. In other examples, the hyaluronan-degrading enzyme lacks a glycosylphosphatidylinositol (GPI) anchor or is not membrane-associated when expressed from a cell. For example, the hyaluronan-degrading enzyme is a hyaluronan-degrading enzyme that contains C-terminal truncations of one or more amino acid residues to remove all or part of a GPI anchor.

In other examples, the hyaluronan-degrading enzyme is a hyaluronidase that is a PH20 or a C-terminally truncated fragment thereof. The PH20 can be a non-human or a human PH20. In some examples of the provided compositions, the PH20 has a sequence of amino acids that contains at least amino acids 36-464 of SEQ ID NO:1, or has a sequence of amino acids that has at least 85% sequence identity to a sequence of amino acids that contains at least amino acids 36-464 of SEQ ID NO:1 and retains hyaluronidase activity. For example, the PH20 has at least 86%, 87%, 88%, 89%, 90%, 91%, 92%, 93%, 94%, 95%, 96%, 97%, 98% or 99% sequence identity to a sequence of amino acids that contains at least amino acids 36-464 of SEQ ID NO:1 and retains hyaluronidase activity. In other examples, the PH20 polypeptide has a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1, or is a variant thereof that exhibits at least 85% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity. In particular examples, the hyaluronan-degrading enzyme is a C-terminal truncated PH20 that has a sequence of amino acids set forth in any of SEQ ID NOS: 4-9.

In some examples, the provided compositions containing a therapeutically effective amount of a hyaluronan-degrading enzyme and $MgCl_2$ contain a hyaluronan-degrading enzyme in an amount that is between or about between 10 U/mL to 5000 U/mL, 50 U/mL to 4000 U/mL, 100 U/mL to 2000 U/mL, 300 U/mL to 2000 U/mL, 600 U/mL to 2000 U/mL, 100 U/mL to 1000 U/mL, 200 U/mL to 800 U/mL, 100 U/mL to 500 U/mL, or 150 U/mL to 300 U/ml, inclusive. For example, the compositions contain a hyaluronan-degrading enzyme in an amount that is at least or is about or is 30 U/mL, 35 U/mL, 40 U/mL, 45 U/mL, 50 U/mL, 55 U/mL, 60 U/mL, 65 U/mL, 70 U/mL, 75 U/mL, 80 U/mL, 85 U/mL, 90 U/mL, 95 U/mL, 100 U/mL, 105 U/mL, 110 U/mL, 115 U/mL, 120 U/mL, 125 U/mL, 130 U/mL, 135 U/mL, 140 U/mL, 145 U/mL, 150 U/mL, 155 U/mL, 160 U/mL, 170 U/mL, 180 U/mL, 190 U/mL, 200 U/mL, 250 U/mL, 300 U/mL, 350 U/mL, 400 U/mL, 450 U/mL, 500 U/mL, 600 U/mL, 700 U/mL, 800 U/mL, 900 U/mL, 1000 U/mL or 2000 U/mL.

Provided herein are compositions containing a therapeutically effective amount of a hyaluronan-degrading enzyme and MgCl$_2$ wherein the pH of the composition is between or about between 6.5 to 7.2 and the composition contains a hyaluronan-degrading enzyme in an amount that is between or about between 100 U/mL to 500 U/mL, inclusive; MgCl$_2$ at a concentration that is between or about between 50 mM to 150 mM, inclusive; a surfactant that is polysorbate 80 at a percentage (%) of mass concentration (w/v) of between or about between 0.01% to 0.05%, inclusive; methionine at a concentration that is between or about between 5 mM to 20 mM, inclusive; and histidine/HCl at a concentration that is between or about between 5 mM to 50 mM, inclusive.

In some examples, the volume of the provided compositions is between or about between 0.5 mL to 50 mL, 1 mL to 40 mL, 1 mL to 20 mL, 1 mL to 10 mL, or 3 mL to 10 mL, inclusive. The compositions can be formulated for delivery using a vial, syringe, pen, reservoir for a pump or a closed loop system. Also provided herein is a syringe or vial containing any of the compositions provided herein.

The compositions provided herein containing an insulin, such as a regular insulin or a rapid acting insulin analog (e.g. aspart, lispro or glulisine or other insulin analog), can be used in methods and uses for treating diabetes. For example, provided herein are methods of treating diabetes by administering to a subject a therapeutically effective amount of a any of the above stable composition provided herein. The diabetes to be treated includes type 1 diabetes mellitus, type 2 diabetes mellitus or gestational diabetes. Also provided herein are methods for controlling blood glucose levels in a subject by administering to a subject a therapeutically effective amount of a stable composition provided herein containing a fast-acting insulin. In practicing the methods herein, the stable compositions are administered subcutaneously or intraperitoneally, for example, via a syringe or insulin pen or by continuous subcutaneous infusion. In practicing the methods herein, the stable compositions can be administered prior to a meal as prandial insulin therapy. In the methods provided herein, the stable compositions can be administered using a delivery method to achieve continuous subcutaneous insulin infusion, such as via an insulin pump or a closed loop system. In some instances, the methods provided herein include administering another antidiabetic drug, that is selected from among, but not limited to, sulfonylureas, biguanides, meglitinides, thiazolidinediones, alpha-glucosidase inhibitors, peptide analogs, including glucagon-like peptide (GLP) analogs and, gastric inhibitory peptide (GIP) analogs and DPP-4 inhibitors.

DETAILED DESCRIPTION

A. Definitions
B. HYALURONAN DEGRADING ENZYME FORMULATIONS AND GENERATING INSULIN CO-FORMULATIONS
  1. Hyaluronan-Degrading Enzyme Formulations
  2. Fast-Acting Insulin Formulations
  3. Hyaluronan-Degrading Enzyme and Insulin Co-formulations
    a. Opposing requirements for stability
      i. Preservatives
      ii. NaCl and pH
    b. Compatible Co-Formulation
C. HYALURONAN DEGRADING ENZYMES
  1. Hyaluronidases
    a. Mammalian-type hyaluronidases PH20
    b. Bacterial hyaluronidases
    c. Hyaluronidases from leeches, other parasites and crustaceans
  2. Other hyaluronan degrading enzymes
  3. Truncated hyaluronan degrading enzymes or other soluble forms
    a. C-terminal Truncated Human PH20
    b. rHuPH20
  4. Glycosylation of hyaluronan degrading enzymes
  5. Modifications of hyaluronan degrading enzymes to improve their pharmacokinetic properties
D. STABLE HYALURONAN-DEGRADING ENZYME FORMULATIONS
  1. Hyaluronan-Degrading Enzyme
  2. Divalent Cation
  3. pH and Buffer
  4. Surfactant
  5. Anti-Oxidation Agent
  6. Tonicity Modifier
  7. Other Agents or Excipients
  8. Exemplary Stable Hyaluronan-Degrading Enzyme Formulations
E. INSULIN POLYPEPTIDES
Fast-acting insulins
  a. Regular insulin
  b. Fast-acting analogs (also called rapid-acting insulins)
    i. Insulin Lispro
    ii. Insulin Aspart
    iii. Insulin Glulisine
F. STABLE CO-FORMULATIONS OF INSULIN AND HYALURONAN-DEGRADING ENZYME
  1. Components of Stable Co-Formulations
    a. Fast-Acting Insulin
    b. Hyaluronan-Degrading Enzyme
    c. Preservative
    d. NaCl
    e. pH
    f. Buffer
    g. Lys-Lys
    h. Additional Exemplary Excipients or Stablizers
      i. Surfactants
      ii. Tonicity Modifier
      iii. Glycerin
      iv. Antioxidants
      v. Zinc
      vi. Amino acid stabilizer
      vii. Hyaluronidase Inhibitor
      viii. Nicotinic Compound
      ix. Other Excipients or Agents
  2. Exemplary Stable Co-formulations
    a. Exemplary Multi-Dose Injection (MDI) Co-Formulations
    b. Exemplary Continuous Subcutaneous Insulin Infusion (CSII) Co-Formulations
    c. Exemplary Lys-Lys Co-Formulations
G. DOSAGE AND ADMINISTRATION
Mode of administration
  a. Syringes
  b. Insulin pen
  c. Insulin pumps and other insulin delivery devices
  d. Continuous Infusion Pump Systems
    i. Open loop systems
    ii. Closed loop systems
H. METHODS OF PRODUCING NUCLEIC ACIDS ENCODING AN INSULIN OR HYALURONAN DEGRADING ENZYME AND POLYPEPTIDES THEREOF
  1. Vectors and Cells
  2. Linker Moieties
  3. Expression a. Prokaryotic Cells
   b. Yeast Cells
   c. Insect Cells
   d. Mammalian Cells
   e. Plants
  4. Purification Techniques
I. METHODS OF ASSESSING STABILITY AND ACTIVITY
  1. Insulin
  2. Hyaluronan degrading enzymes
J. THERAPEUTIC USES
  1. Diabetes Mellitus
    a. Type 1 diabetes
    b. Type 2 diabetes
    c. Gestational diabetes
  2. Insulin therapy for critically ill patients
K. COMBINATION THERAPIES
L. ARTICLES OF MANUFACTURE AND KITS
M. EXAMPLES

A. DEFINITIONS

Unless defined otherwise, all technical and scientific terms used herein have the same meaning as is commonly understood by one of skill in the art to which the invention(s) belong. All Patents, Pat. applications, published applications and publications, GENBANK sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, "insulin" refers to a hormone, precursor or a synthetic or recombinant analog thereof that acts to increase glucose uptake and storage and/or decrease endogenous glucose production. An exemplary human insulin is translated as a 110 amino acid precursor polypeptide, preproinsulin (SEQ ID NO:101), containing a 24 amino acid signal peptide that directs the protein to the endoplasmic reticulum (ER) wherein the signal sequence is cleaved, resulting in proinsulin (SEQ ID NO:102). Proinsulin is processed further to release the 31 amino acid C— or connecting chain peptide (corresponding to amino acid residues 57 to 87 of the preproinsulin polypeptide set forth in SEQ ID NO:101, and to amino acid residues 33 to 63 of the proinsulin polypeptide set forth in SEQ ID NO:102). The resulting insulin contains a 21 amino acid A-chain (corresponding to amino acid residues 90 to 110 of the preproinsulin polypeptide set forth in SEQ ID NO:101, and to amino acid residues 66 to 86 of the proinsulin polypeptide set forth in SEQ ID NO:102) and a 30 amino acid B-chain (corresponding to amino acid residues 25 to 54 of the preproinsulin polypeptide set forth in SEQ ID NO:101, and to amino acid residues 1 to 30 of the proinsulin polypeptide set forth in SEQ ID NO:102) which are cross-linked by disulfide bonds. A properly cross-linked human insulin contains three disulfide bridges: one between position 7 of the A-chain and position 7 of the B-chain, a second between position 20 of the A-chain and position 19 of the B-chain, and a third between positions 6 and 11 of the A-chain. Reference to insulin includes preproinsulin, proinsulin and insulin polypeptides in single-chain or two-chain forms, truncated forms thereof that have activity, and includes allelic variants and species variants, variants encoded by splice variants, and other variants, such as insulin analogs, including polypeptides that have at least 40%, 45%, 50%, 55%, 60%, 65%, 70%, 75%, 80%, 85%, 90%, 95%, 96%, 97%, 98%, 99% or more sequence identity to the precursor polypeptide set forth in SEQ ID NO:101 or the mature form thereof. Exemplary insulin analogs include those set forth in SEQ ID NOS:147-149, 152, and those containing an A-chain set forth in SEQ ID NOS:150, 156, 158, 160, 162 and 164 and/or a B chain set forth in SEQ ID NOS:151, 153-155, 157, 159, 161, 163 and 165.

Exemplary insulin polypeptides are those of mammalian, including human, origin. Exemplary amino acid sequences of insulin of human origin are set forth in SEQ ID NOS: 101-104. Exemplary insulin analogs include those set forth in SEQ ID NOS:147-149, 152, and those containing an A-chain set forth in SEQ ID NOS:150, 156, 158, 160, 162 and 164 and/or a B chain set forth in SEQ ID NOS:151, 153-155, 157, 159, 161, 163 and 165. Insulin polypeptides also include any of non-human origin including, but not limited to, any of the precursor insulin polypeptides set forth in SEQ ID NOS:105-146. Reference to an insulin includes monomeric and multimeric insulins, including hexameric insulins, as well as humanized insulins.

As used herein, "fast-acting insulin" refers to any insulin or fast-acting insulin composition for acute administration to a diabetic subject in response to an actual, perceived, or anticipated hyperglycemic condition in the subject arising at the time of, or within about four hours following, administration of the fast-acting insulin (such as a prandial hyperglycemic condition resulting or anticipated to result from, consumption of a meal), whereby the fast-acting insulin is able to prevent, control or ameliorate the acute hyperglycemic condition. Typically a fast-acting insulin is an insulin that exhibits peak insulin levels at or about not more than four hours following subcutaneous administration to a subject. Fast-acting insulins include recombinant insulins and isolated insulins (also referred to as "regular" insulins) such as the insulin sold as Humulin® R, porcine insulins and bovine insulins, as well as rapid acting insulin analogs (also termed fast-acting insulin analogs herein) designed to be rapid acting by virtue of amino acid changes. Exemplary regular insulin preparations include, but are not limited to, human regular insulins, such as those sold under the trademarks Humulin® R, Novolin® R and Velosulin®, Insulin Human, USP and Insulin Human Injection, USP, as well as acid formulations of insulin, such as, for example, Toronto Insulin, Old Insulin, and Clear Insulin, and regular pig insulins, such as Iletin II® (porcine insulin). Regular insulins typically have an onset of action of between 30 minutes to an hour, and a peak insulin level of 2-5 hours post administration.

As used herein, rapid acting insulin analogs (also called fast-acting insulin analogs) are insulins that have a rapid onset of action. Rapid insulins typically are insulin analogs that have been engineered, such as by the introduction of one or more amino acid substitutions, to be more rapid acting than regular insulins. Rapid acting insulin analogs typically have an onset of action of 10-30 minutes post injection, with peak insulin levels observed 30-90 minutes post injection. Exemplary rapid acting insulin analogs include, but are not limited to, for example, insulin lispro (e.g. Humalog® insulin), insulin aspart (e.g. NovoLog® insulin), and insulin glulisine (e.g. Apidra® insulin) the fast-acting insulin composition sold as VIAject® and VIAtab® (see, e.g., U.S. Pat.

No. 7,279,457). Also included are any other insulins that have an onset of action of 30 minutes or less and a peak level before 90 minutes, typically 30-90 minutes, post injection.

As used herein, a human insulin refers to an insulin that is synthetic or recombinantly produced based upon the human polypeptide, including allelic variants and analogs thereof.

As used herein, fast-acting human insulins or human fast-acting insulin compositions include any human insulin or composition of a human insulin that is fast-acting, but excludes non-human insulins, such as regular pig insulin.

As used herein, the terms "basal-acting insulins," or "basal insulins" refer to insulins administered to maintain a basal insulin level as part of an overall treatment regimen for treating a chronic condition such diabetes. Typically, a basal-acting insulin is formulated to maintain an approximately steady state insulin level by the controlled release of insulin when administered periodically (e.g. once or twice daily). Basal-acting insulins include crystalline insulins (e.g. NPH and Lente®, protamine insulin, surfen insulin), basal insulin analogs (insulin glargine, HOE 901, NovoSol Basal) and other chemical formulations of insulin (e.g. gum arabic, lecithin or oil suspensions) that retard the absorption rate of regular insulin. As used herein, the basal-acting insulins can include insulins that are typically understood as long-acting (typically reaching a relatively low peak concentration, while having a maximum duration of action over about 20-30 hours) or intermediate-acting (typically causing peak insulin concentrations at about 4-12 hours after administration).

As used herein, the terms "hyperglycemic condition" or "hyperglycemia" refer to an undesired elevation in blood glucose.

As used herein, the term "hypoglycemic condition" or "hypoglycemia" refers to an undesired drop in blood glucose.

As used herein, glycemic control or "controlling blood glucose levels" refers to the maintenance of blood glucose concentrations at a desired level, typically between 70-130 mg/dL or 90-110 mg/dL.

As used herein, a closed loop system is an integrated system for providing continuous glycemic control. Closed loop systems contain a mechanism for measuring blood glucose, a mechanism for delivering one or more compositions, including an insulin composition, and a mechanism for determining the amount of insulin needed to be delivered to achieve glycemic control. Typically, therefore, closed loop systems contain a glucose sensor, an insulin delivery device, such as an insulin pump, and a controller that receives information from the glucose sensor and provides commands to the insulin delivery device. The commands can be generated by software in the controller. The software typically includes an algorithm to determine the amount of insulin required to be delivered to achieve glycemic control, based upon the blood glucose levels detected by the glucose sensor or anticipated by the user. An open loop system refers to similar devices, except that the devices do not automatically measure and respond to glucose levels.

As used herein, dosing regime refers to the amount of insulin administered and the frequency of administration. The dosing regime is a function of the disease or condition to be treated, and thus can vary.

As used herein, a hyaluronan degrading enzyme refers to an enzyme that catalyzes the cleavage of a hyaluronan polymer (also referred to as hyaluronic acid or HA) into smaller molecular weight fragments. Exemplary of hyaluronan degrading enzymes are hyaluronidases, and particular chondroitinases and lyases that have the ability to depolymerize hyaluronan. Exemplary chondroitinases that are hyaluronan degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase contains two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Flavobacterium heparinum*, set forth in SEQ ID NO:99, *Victivallis vadensis*, set forth in SEQ ID NO:100 and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2):121-4; Michelacci et al. (1976) *J. Biol. Chem.* 251:1154-8; Tsuda et al. (1999) *Eur. J. Biochem.* 262:127-133).

As used herein, hyaluronidase refers to a class of hyaluronan degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS:10, 11, 64 and BH55 (U.S. Pat. Nos. 5,747,027 and 5,827,721), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), sheep (SEQ ID NOS:26, 27, 63 and 65), orangutan (SEQ ID NO:28), cynomolgus monkey (SEQ ID NO:29), guinea pig (SEQ ID NO:30), chimpanzee (SEQ ID NO:185), rhesus monkey (SEQ ID NO:186), *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* (SEQ ID NO:70); 18RS21 (SEQ ID NO:71); serotype Ia (SEQ ID NO:72); serotype III (SEQ ID NO:73), *Staphylococcus aureus* (strain COL) (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* (SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases Vitrase® (ovine hyaluronidase) and Amphadase® (bovine hyaluronidase).

Reference to hyaluronan degrading enzyme, hyaluronidase or PH20 includes precursor hyaluronan degrading enzyme polypeptides and mature hyaluronan degrading enzyme polypeptides (such as those in which a signal sequence has been removed), truncated forms thereof that have activity (e.g. C-terminally truncated forms), and includes allelic variants and species variants, variants encoded by splice variants, and other variants, including polypeptides that have at least 40%, 45%, 50%, 55%, 60%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-100, or the mature form thereof. For example, reference to a hyaluronan-degrading enzyme (e.g. PH20) includes the mature human PH20 set forth in SEQ ID NO:2 and truncated forms thereof that have activity, and includes allelic variants and species variants, variants encoded by splice variants and other variants including polypeptides that have at least 40%, 45%, 50%, 55%, 60%, 65%, 70%, 75%, 80%, 85%, 90%, 95%, 96%, 97%, 98%, 99% or more sequence identity to SEQ ID NO:2. For example, reference to hyaluronan degrading enzyme also includes the human PH20 precursor polypeptide variants set forth in SEQ ID NOS:50-51. Hyaluronan degrading enzymes also include those that contain chemical or posttranslational modifications and those that do not contain chemical or posttranslational modifications. Such modifications include, but are not limited to, pegylation, albumination, glycosylation, farnesylation, carboxylation, hydroxylation, phosphorylation, and other polypeptide modifications known in the art.

As used herein, PH20 refers to a type of hyaluronidase that occurs in sperm and is neutral-active. PH-20 occurs on the sperm surface, and in the lysosome-derived acrosome, where it is bound to the inner acrosomal membrane. PI-120 includes those of any origin including, but not limited to, human, chimpanzee, Cynomolgus monkey, Rhesus monkey, murine, bovine, ovine, guinea pig, rabbit and rat origin. Exemplary PH20 proteins include, but are not limited to, human (precursor polypeptide set forth in SEQ ID NO:1, mature polypeptide set forth in SEQ ID NO: 2), bovine (SEQ ID NOS: 11 and 64), rabbit (SEQ ID NO: 25), ovine PH20 (SEQ ID NOS: 27, 63 and 65), cynomolgus monkey (SEQ ID NO: 29), guinea pig (SEQ ID NO: 30), rat (SEQ ID NO: 31), mouse (SEQ ID NO: 32), chimpanzee (SEQ ID NO: 185) and rhesus monkey (SEQ ID NO:186) PH20 polypeptides. Reference to PH20 includes precursor PH20 polypeptides and mature PH20 polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NO:1, 10, 25, 27, 30-31, 63-65, 185-186, or the mature forms thereof. PH20 polypeptides also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art. Examples of commercially available bovine or ovine soluble hyaluronidases are Vitrase® hyaluronidase (ovine hyaluronidase) and Amphadase® hyaluronidase (bovine hyaluronidase).

As used herein, a soluble hyaluronidase refers to a polypeptide that is secreted from cells and is not membrane-anchored or associated, and hence can be characterized by its solubility under physiologic conditions. Soluble hyaluronidases can be distinguished, for example, by its partitioning into the aqueous phase of a Triton X-114 solution warmed to 37° C. (Bordier et al., (1981) *J. Biol. Chem.*, 256:1604-7). Membrane-anchored, such as lipid anchored hyaluronidases, will partition into the detergent rich phase, but will partition into the detergent-poor or aqueous phase following treatment with Phospholipase-C. Included among soluble hyaluronidases are membrane anchored hyaluronidases in which one or more regions associated with anchoring of the hyaluronidase to the membrane has been removed or modified, where the soluble form retains hyaluronidase activity. Hence, soluble hyaluronidase, such as soluble PH20 polypeptides, include truncated forms thereof, for example, C-terminally truncated forms in which one or more amino acids of the glycosylphosphatidylinositol (GPI) anchor is lacking. Soluble hyaluronidases include recombinant soluble hyaluronidases and those contained in or purified from natural sources, such as, for example, testes extracts from sheep or cows. Exemplary of such soluble hyaluronidases are soluble human PH20. Other soluble hyaluronidases include ovine (SEQ ID NOS:27, 63, 65) and bovine (SEQ ID NOS:11, 64) PH20.

As used herein, soluble human PH20 or sHuPH20 include mature PH20 polypeptides lacking all or a portion of the glycosylphosphatidylinositol (GPI) attachment site at the C-terminus such that upon expression, the polypeptides are not associated with the membrane of a host cell in which they are produced so that they are secreted and, thus, soluble in the cell culture medium. Hence, soluble human PH20 includes C-terminal truncated human PH20 polypeptides. Exemplary soluble or C-terminal truncated PH20 polypeptides include mature polypeptides having an amino acids sequence set forth in any one of SEQ ID NOS: 4-9, 47-48, 234-254, and 267-273, or a polypeptide that exhibits at least 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS: 4-9, 47-48, 234-254, and 267-273. Exemplary sHuPH20 polypeptides include mature polypeptides having an amino acid sequence set forth in any one of SEQ ID NOS:4-9 and 47-48. The precursor polypeptides for such exemplary sHuPH20 polypeptides include a signal sequence. Exemplary of the precursors are those set forth in SEQ ID NOS:3 and 40-46, each of which contains a 35 amino acid signal sequence at amino acid positions 1-35. Soluble HuPH20 polypeptides also include those degraded during or after the production and purification methods described herein.

As used herein, a recombinant human PH20 referred to as rHuPH20 refers to a secreted soluble form of human PH20 that is recombinantly expressed in Chinese Hamster Ovary (CHO) cells. Soluble rHuPH20 is the product produced by nucleic acid that encodes a signal sequence, such as the native signal sequence, and includes nucleic acid that encodes amino acids 36-482 and for which an exemplary sequence, including the nucleic acid encoding the native signal sequence is set forth in SEQ ID NO:49. Also included are DNA molecules that are allelic variants thereof and other soluble variants. The nucleic acid encoding soluble rHuPH20 is expressed in CHO cells, which secrete the mature polypeptide. As produced in the culture medium, there is heterogeneity at the C-terminus so that the product includes a mixture of species that can include any one or more of SEQ ID NOS: 4-9 in various abundance. Corresponding allelic variants and other variants also are included, including those corresponding to the precursor human PH20 polypeptides set forth in SEQ ID NOS:50-51. Other variants can have 60%, 70%, 80%, 85%, 90%, 91%, 92%, 93%, 94%, 95%, 96%, 97%, 98%, 99% or more sequence identity with any of SEQ ID NOS:4-9 and 47-48 as long they retain a hyaluronidase activity and are soluble.

As used herein, "super fast-acting insulin composition" refers to an insulin composition containing a fast-acting insulin, particularly a rapid acting insulin analog, such as an insulin analog with a more rapid onset insulin, and a hyaluronan degrading enzyme (such as, but not limited to, rHuPH20 preparations), such that the insulin composition, over the first forty minutes following parenteral administration to a subject, provides a cumulative systemic insulin exposure in the subject that is greater than the cumulative systemic insulin exposure provided to the subject over the same period after administering the same dosage of a fast-acting insulin, by the same route, in the absence of the hyaluronan degrading enzyme. The super fast-acting insulin composition optionally can include a basal-acting insulin.

As used herein, a formulation refers to a composition containing at least one active or pharmaceutical agent and one or more excipients.

As used herein, a co-formulation refers to a composition containing two or more active or pharmaceutical agents and one or more excipients. For example, a co-formulation of a fast-acting insulin and a hyaluronan degrading enzyme contains a fast-acting insulin, a hyaluronan degrading enzyme, and one or more excipients.

As used herein, a composition is said to be stable under defined conditions if the active ingredients therein retains at least a requisite level of activity and/or purity and/or potency or recovery compared to the initial activity and/or purity and/or potency or recovery. For purposes herein, a composition is stable if it retains at least 50% of the hyaluronan-degrading enzyme activity and/or if it retains at least 90% of insulin potency or recovery and/or at least 90% of the insulin purity.

As used herein, a stable co-formulation, which contains at least two active ingredients, is stable if each active ingredient retains at least the requisite level of activity and/or purity and/or potency or recovery compared to the initial activity and/or purity and/or potency or recovery. For purposes herein, a coformulation is stable if it retains at least 50% of the hyaluronan-degrading enzyme activity and if it retains at least 90% of insulin potency or recovery and/or at least 90% of the insulin purity.

As used herein, defined conditions refer to conditions of storage and/or use.

As used herein, "storage" means that a formulation is not immediately administered to a subject once prepared, but is kept for a period of time under particular conditions (e.g. particular temperature; time, liquid or lyophilized form) prior to use. For example, a liquid formulation can be kept for days, weeks, months or years, prior to administration to a subject under varied temperatures such as refrigerated (0° to 10° C., such as 2° C. to 8° C.), room temperature (e.g. temperature up to 32° C., such as 18° C. to about or at 32° C.), or elevated temperature (e.g., 30° C. to 42° C., such as 32° C. to 37° C. or 35° C. to 37° C.).

As used herein, "use" with reference to a condition associated with stability refers to the act of employing the formulation for a specific purpose. Particular applications can influence the activity or properties of a protein or agent. For example, certain applications can require that the formulation is subjected to certain temperatures for certain time periods, is subjected to fluctuations in temperature and or is subjected to agitation, shaking, stirring or other similar motion that can affect the stability (e.g. activity and/or solubility) of the active agents. Exemplary of a condition is continuous infusion methods, whereby active agents are continuously infused to a subject from a user-associated pump or infuser over a course of several days. Such a condition can be associated with agitation and fluctuations in temperature.

As used herein, defined conditions for storage or use under which stability is measured includes temperature conditions, time of storage conditions and/or use conditions. For example, defined temperature conditions include low or refrigerated temperatures of 2° C. to 8° C., ambient temperatures of 20° C. to 30° C. or elevated temperatures of 32° C. to 40° C. In another example, defined time conditions refers to the length of storage under varied temperature conditions, such as storage for days (at least 3 days, 4 days, 5 days, 6 days or 7 days), weeks (at least one week, at least two weeks, at least three weeks or at least for weeks) or months (at least 1 months, 2 months, 3 months, 4 months, 5 months, 6 months, 12 months, 18 months, 24 months or more). In a further example, defined use conditions refers to conditions that disturb or alter the composition mixture, such as conditions of agitation.

As used herein, a single dosage formulation refers to a formulation or co-formulation for direct administration. Generally, a single dosage formulation is a formulation that contains a single dose of therapeutic agent for direct administration. Single dosage formulations generally do not contain any preservatives.

As used herein, a multi-dose formulation refers to a formulation that contains multiple doses of a therapeutic agent and that can be directly administered to provide several single doses of the therapeutic agent. The doses can be administered over the course of minutes, hours, weeks, days or months. Multidose formulations can allow dose adjustment, dose-pooling and/or dose-splitting. Because multi-dose formulations are used over time, they generally contain one or more preservatives to prevent microbial growth. Multi-dose formulations can be formulated for injection or infusion (e.g. continuous infusion).

As used herein, a "stable multiple dose injection (MDI) co-formulation" refers to a stable co-formulation that is stable for at least 6 months at a temperature from or from about 2° C. to 8° C. and/or for at least 14 days at a temperature from or from about 20° C. to 30° C., such that the requisite level of activity and/or purity and/or potency or recovery is retained over the defined time and temperature compared to the initial activity and/or purity and/or potency or recovery. For example, a stable multiple dose injection formulation retains at least 50% of the hyaluronan-degrading enzyme activity and at least 90% of insulin potency or recovery and/or at least 90% of the insulin purity for at least 6 months at a temperature from or from about 2° C. to 8° C. and/or for at least 14 days at a temperature from or from about 20° C. to 30° C.

As used herein, a "stable continuous insulin infusion formulation" refers to a stable co-formulation that is stable for at least 3 days at a temperature from or from about 32° C. to 40° C., such that the requisite level of activity and/or purity and/or potency or recovery is retained over the defined time and temperature compared to the initial activity and/or purity and/or potency or recovery. For example, a stable continuous insulin infusion formulation retains at least 50% of the hyaluronan-degrading enzyme activity and at least 90% of insulin potency or recovery and/or at least 90% of the insulin purity for at least 3 days at a temperature from or from about 32° C. to 40° C.

As used herein, continuous subcutaneous insulin infusion therapy (CSII) refers to an insulin dosage regimen whereby insulin is administered at programmed rates over a course of several days from a small infuser or pump subcutaneously via an infusion set connected to the pump. Typically, CSII therapy continues for 2-4 days before the infusion set and pump reservoir must be replaced. The treatment combines continuous baseline insulin release (basal rate) and additional insulin bolus doses before meals and in response to high glycaemia values (i.e. correction bolus). CSII therapy generally uses a battery powered syringe driver, insulin pump or other similar device to deliver a fast-acting insulin, in particular an insulin analog, according to the dosage regimen. Generally, scheduling of continuous baseline insulin release is set by a physician for each patient. Bolus doses are determined based on prandial needs and glycemic responses. Hence, CSII therapy is patient specific. It is well within the level of a skilled physician and patient to determine the particular insulin dosage regimen for each patient depending on the needs of the patients and other patient-specific parameters such as weight, age, exercise, diet and clinical symptoms of the patient.

As used herein, a stabilizing agent refers to compound added to the formulation to protect either the hyaluronan degrading enzyme or insulin or both from degradation, such as under the conditions of salt, pH and temperature at which the co-formulations herein are stored or used. Thus, included are agents that prevent proteins from degradation from other components in the compositions. Exemplary of such agents are amino acids, amino acid derivatives, amines, sugars, polyols, salts and buffers, surfactants, inhibitors or substrates and other agents as described herein.

As used herein, Lysyl lysine (Lys-Lys or dilysine) refers to a Lys-Lys dipeptide, salt, derivative, analogue or mimetic thereof. For example, reference to Lys-Lys includes salts thereof, such as the dihydrochloride salt of Lys-Lys, i.e. Lys-Lys dihydrochloride (or dilysine dihydrochloride; H-Lys-Lys-OH HCl). Lys-Lys dihydrochloride is represented by the following formula:

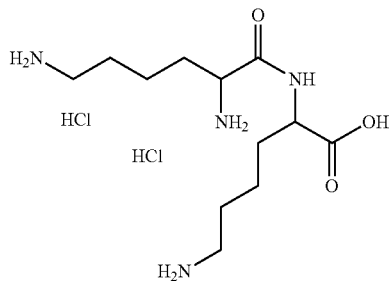 [SMILES: NCCCCC(N)C(=O)NC(CCCCN)C(=O)O ; Cl ; Cl]

Reference to Lys-Lys also includes derivatives thereof, such as derivatives containing a protected groups, such as an Fmoc-, Noc- or Cbz. Examples of commercially available Lys-Lys dihydrochlorides include, but are not limited to, those available from Sigma Aldrich, RnD Chem., MP Bio, Tetrahedron Scientific Inc., and Crescent Chemical Company. An exemplary commercially available Lys-Lys dihydrochloride is the Lys-Lys dihydrochloride available from Sigma Aldrich (Product No. L5502) or RnD Chem (Product No. G-2675).

As used herein, an antimicrobial effectiveness test demonstrates the effectiveness of the preservative system in a product. A product is inoculated with a controlled quantity of specific organisms. The test then compares the level of microorganisms found on a control sample versus the test sample over a period of 28 days. Parameters for performing an antimicrobial effectiveness test are known to one of skill in the art as described herein.

As used herein, an anti-microbially or anti-microbial effective amount of a preservative refers to an amount of the preservative that kills or inhibits the propagation of microbial organisms in a sample that may be introduced from storage or use. For example, for multiple-dose containers, an anti-microbially effective amount of a preservative inhibits the growth of microorganisms that may be introduced from repeatedly withdrawing individual doses. USP and EP (EPA and EPB) have anti-microbial requirements that determine preservative effectiveness, and that vary in stringency. For example, an anti-microbial effective amount of a preservative is an amount such that at least a 1.0 $\log_{10}$ unit reduction in bacterial organisms occurs at 7 days following inoculation in an antimicrobial preservative effectiveness test (APET). In a particular example, an anti-microbial effective amount of a preservative is an amount such that at least a 1.0 $\log_{10}$ unit reduction in bacterial organisms occurs at 7 days following inoculation, at least a 3.0 $\log_{10}$ unit reduction of bacterial organisms occurs at 14 days following inoculation at least no further increase in bacterial organisms occurs after 28 days following inoculation; and at least no increase in fungal organisms occurs after 7 days following inoculation. In a further example, an anti-microbial effective amount of a preservative is an amount such that at least a 1.0 $\log_{10}$ unit reduction of bacterial organisms occurs at 24 hours following inoculation, at least a 3.0 $\log_{10}$ unit reduction of bacterial organisms occurs at 7 days following inoculation, no further increase in bacterial organisms occurs after 28 days following inoculation, at least a 1.0 $\log_{10}$ unit reduction of fungal organisms occurs at 14 days following inoculation, and at least no further increase in fungal organisms occurs after 28 days following inoculation. In an additional example, an anti-microbial effective amount of a preservative is an amount such that at least a 2.0 $\log_{10}$ unit reduction of bacterial organisms at 6 hours following inoculation, at least a 3.0 $\log_{10}$ unit reduction of bacterial organisms occurs at 24 hours following inoculation, no recovery of bacterial organisms occurs after 28 days following inoculation of the composition with the microbial inoculum, at least a 2.0 $\log_{10}$ unit reduction of fungal organisms occurs at 7 days following inoculation, and at least no further increase in fungal organisms occurs after 28 days following inoculation.

As used herein, the "excipient" refers to a compound in a formulation of an active agent that does not provide the biological effect of the active agent when administered in the absence of the active agent. Exemplary excipients include, but are not limited to, salts, buffers, stabilizers, tonicity modifiers, metals, polymers, surfactants, preservatives, amino acids and sugars.

As used herein, a "buffer" refers to a substance, generally a solution, that can keep its pH constant, despite the addition of strong acids or strong bases and external influences of temperature, pressure, volume or redox potential. Buffer prevents change in the concentration of another chemical substance, e.g. proton donor and acceptor systems that prevent marked changes in hydrogen ion concentration (pH). The pH values of all buffers are temperature and concentration dependent. The choice of buffer to maintain a pH value or range can be empirically determined by one of skill in the art based on the known buffering capacity of known buffers. Exemplary buffers include but are not limited to, bicarbonate buffer, cacodylate buffer, phosphate buffer or Tris buffer. For example, Tris buffer (tromethamine) is an amine based buffer that has a pKa of 8.06 and has an effective pH range between 7.9 and 9.2. For Tris buffers, pH increases about 0.03 unit per ° C. temperature decrease, and decreases 0.03 to 0.05 unit per ten-fold dilution.

As used herein, activity refers to a functional activity or activities of a polypeptide or portion thereof associated with a full-length (complete) protein. Functional activities include, but are not limited to, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, hyaluronidase activity refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as soluble rHuPH20, are known in the art and described herein. Exemplary assays include the microturbidity assay described below (see e.g. Example 2) that measures cleavage of hyaluronic acid by hyaluronidase indirectly by detecting the insoluble precipitate formed when the uncleaved hyaluronic acid binds with serum albumin. Reference Standards can be used, for example, to generate a standard curve to determine the activity in Units of the hyaluronidase being tested.

As used herein, "functionally equivalent amount" or grammatical variations thereof, with reference to a hyaluronan degrading enzyme, refers to the amount of hyaluronan degrading enzyme that achieves the same effect as an amount (such as a known number of Units of hyaluronidase activity) of a reference enzyme, such as a hyaluronidase. For example, the activity of any hyaluronan degrading enzyme can be compared to the activity of rHuPH20 to determine the functionally equivalent amount of a hyaluronan degrading enzyme that would achieve the same effect as a known amount of rHuPH20. For example, the ability of a hyaluronan degrading enzyme to act as a spreading or diffusing agent can be assessed by injecting it into the lateral skin of mice with trypan blue (see e.g. U.S. Pat. Publication No. 20050260186), and the amount of hyaluronan degrading enzyme required to achieve the same amount of diffusion as, for example, 100 units of a Hyaluronidase Reference Standard, can be determined. The amount of hyaluronan degrading enzyme required is, therefore, functionally equivalent to 100 units. In another example, the ability of a hyaluronan degrading enzyme to increase the level and rate of absorption of a co-administered insulin can be assessed in human subjects, and the amount of hyaluronan degrading enzyme required to achieve the same increase in the level and rate of absorption of insulin, for example, the administered quantity of rHuPH20, can be determined (such as by assessing the maximum insulin concentration in the blood ($C_{max}$) the time required to achieve maximum insulin concentration in the blood ($t_{max}$) and the cumulative systemic insulin exposure over a given period of time (AUC)).

As used herein, the residues of naturally occurring α-amino acids are the residues of those 20 α-amino acids found in nature which are incorporated into protein by the specific recognition of the charged tRNA molecule with its cognate mRNA codon in humans.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to two amino acids in length, and less than or equal to 40 amino acids in length.

As used herein, the amino acids that occur in the various sequences of amino acids provided herein are identified according to their known, three-letter or one-letter abbreviations (Table 1). The nucleotides that occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the a-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted 37 C.F.R. §§ 1.821-1.822, abbreviations for amino acid residues are shown in Table 1:

TABLE 1

Table of Correspondence

| SYMBOL | | AMINO ACID |
|---|---|---|
| 1-Letter | 3-Letter | |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |
| N | Asn | asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§ 1.821-1.822, and incorporated herein by reference. Furthermore, a dash at the beginning or end of an amino acid residue sequence indicates a peptide bond to a further sequence of one or more amino acid residues, to an amino-terminal group such as NH, or to a carboxyl-terminal group such as COOH.

As used herein, "naturally occurring amino acids" refer to the 20 L-amino acids that occur in polypeptides.

As used herein, "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences.

As used herein, "identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physicochemical properties of the residues involved. Alignments can be global (alignment of the compared sequences over the entire length of the sequences and including all residues) or local (the alignment of a portion of the sequences that includes only the most similar region or regions). "Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carrillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence*

Data, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carrillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(*I*):387 (1984)), BLASTP, BLASTN, FASTA (Altschul, S. F., et al., *J Molec Biol* 215:403 (1990)); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman (1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) Nucl. Acids Res. 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 100% relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human.

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less that about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein, the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomassie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms. Diseases and disorders of interest herein include diabetes mellitus.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a co-formulation of insulin and hyaluronan degrading enzyme provided herein.

As used herein, a pharmaceutically effective agent, includes any therapeutic agent or bioactive agents, including, but not limited to, for example, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, a therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject exhibiting symptoms of a disease or disorder.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, a therapeutically effective insulin dosage is the amount of insulin required or sufficient to achieve glycemic control. This amount can be determined empirically, such as by glucose or meal challenge. The compositions provided herein contain a therapeutically effective amount or concentration of insulin so that therapeutically effective dosages are administered.

As used herein, unit dose form refers to physically discrete units suitable for human and animal subjects and packaged individually as is known in the art.

As used herein, an "article of manufacture" is a product that is made and sold. As used throughout this application, the term is intended to encompass a fast-acting insulin composition and hyaluronan degrading enzyme composition contained in the same or separate articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a combination of compositions provided herein and another item for a purpose including, but not limited to, reconstitution, activation, instruments/devices for delivery, administration, diagnosis, and assessment of a biological activity or property. Kits optionally include instructions for use.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The enzymes provided herein are from any source, animal, plant, prokaryotic and fungal. Most enzymes are of animal origin, including mammalian origin.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochemistry* 11:1726).

B. HYALURONAN-DEGRADING ENZYME FORMULATIONS AND GENERATING INSULIN CO-FORMULATIONS

Provided herein are stable formulations of a hyaluronan-degrading enzyme, such as a soluble hyaluronidase, for example a PH20. Generally, hyaluronan-degrading enzymes requires a-relative high salt in order to retain enzymatic activity (see e.g. U.S. Patent Publication No. US20110066111). Existing formulations also contain human serum albumin (HSA) for stability. It is found herein that Lys-Lys and magnesium chloride ($MgCl_2$) stabilize hyaluronan-degrading enzymes (e.g. a soluble hyaluronidase, for example PH20) more than NaCl. Further, in the presence of Lys-Lys or $MgCl_2$, HSA is not necessary nor required. The formulations provided herein offer advantages over existing formulations, including increased stability, in particular at higher temperatures and for longer times. Provided herein are stable formulations containing Lys-Lys and/or $MgCl_2$. In particular, provided herein are stable formulations of a hyaluronan-degrading enzyme (e.g. a soluble hyaluronidase, for example PH20) containing Lys-Lys as a stabilizer.

Co-formulations of a hyaluronan-degrading enzyme with another therapeutic agent also should exhibit stability under various conditions. This can be a problem when the formulation requirements of the other therapeutic agent differs, and sometimes opposes, the formulation requirements required for a hyaluronan-degrading enzyme. It is found herein that this is the case for co-formulations of a hyaluronan-degrading enzyme and insulin when admixed. Provided herein are stable co-formulations of a hyaluronan-degrading enzyme (e.g. a soluble hyaluronidase such as a PH20) and an insulin, for example, a fast-acting insulin or insulin analog.

Stable formulations, including the marketed formulations, of fast-acting insulins, typically contain different excipients and components and/or different concentrations of excipients and components, which are required for the stability, solubility and activity of the insulin, than those found in stable formulations of hyaluronan degrading enzymes, such as soluble hyaluronidases. These optimized formulations of insulins and soluble hyaluronidases are incompatible when mixed together in a co-formulation, such that the stability, solubility and/or activity of the co-formulated insulin and soluble hyaluronidase are greatly reduced. Such incompatibility is a major barrier to developing stable co-formulations of these agents.

1. Hyaluronan-Degrading Enzyme Formulations

Existing formulations of a hyaluronan degrading enzyme generally contain NaCl, typically 130 mM to 150 mM NaCl.

pH 5.5 to 6.5. In addition to lower pH, human hyaluronidase formulations contain more NaCl than insulin formulations, both of which promote stability of the protein and maintain enzymatic activity. Also, human soluble hyaluronidase formulations, such as Hylenex® recombinant (hyaluronidase human injection) have to date been single dose formulations. As such, they do not contain any preservatives.

2. Fast-Acting Insulin Formulations

Fast-acting insulins, including regular insulin and rapid-acting insulin analogs, typically are formulated to optimize insulin solubility, stability and purity at refrigerated temperatures (e.g. 4° C., such as for long term storage) as well as elevated temperatures (e.g. 25° C. and 30° C.). The formulations are made to confer stability over time, in particular, for multidose use and packaging. For example, the labels for marketed insulin products, including Humulin®, Humalog®, Novolog® and Apidra®, indicate stability of at least 24 months at storage temperature of 2-8° C. and 28 days at 25° C. or 30° C. storage. Also, the formulations are believed to be stable for at least 6 days at storage temperatures of or of about 37° C.

Although the optimal formulations for each insulin can differ, there typically are some commonalties in the formulations. For example, insulin formulations typically contain a buffer, tonicity modifier(s) and one or more preservatives. Many fast-acting insulins also contain zinc, while some also contain a stabilizer. Further, insulin formulations typically are prepared at high neutral pH (e.g. 7.0-7.8). Table 2 below sets forth the select marketed formulations of four fast-acting insulins, including a regular insulin and three rapid-acting insulin analogs.

TABLE 2

Select fast-acting insulin formulations

| | API | | | | Tonicity Modifier | | | Preservative | |
|---|---|---|---|---|---|---|---|---|---|
| Insulin | (U/mL) | pH | Zn | Buffer | NaCl | Glycerin | Stabilizer | Phenol | m-cresol |
| Humulin® recombinant insulin | 100 or 500 | 7.0-7.8 | 0.017 or 0.085 mg/mL | Dibasic sodium phosphate | — | 16 mg/mL (170 mM) | — | | |
| Humalog® insulin lispro | 100 | 7.0-7.8 | 0.0197 mg/mL | 1.88 mg/mL (13.2 mM) dibasic sodium phosphate | — | 16 mg/mL (170 mM) | — | trace | 3.15 mg/mL (0.315%) |
| NovoLog® insulin aspart | 100 | 7.2-7.6 | 0.0196 mg/mL | 1.25 mg/mL (7 mM) disodium hydrogen phosphate dihydrate | 0.58 mg/mL (10 mM) | 16 mg/mL (170 mM) | — | 1.5 mg/mL (0.15%) | 1.72 mg/mL (0.172%) |
| Apidra® insulin glulisine | 100 | 7.3 | — | 6 mg/mL (50 mM) Tris | 5 mg/mL (85 mM) | — | 0.01% poly-sorbate 20 | — | 3.15 mg/mL (0.315%) |

For example, Hylenex® recombinant (hyaluronidase human injection) contains, per mL, 8.5 mg NaCl (145 mM), 1.4 mg dibasic sodium phosphate (9.9 mM), 1.0 mg human albumin, 0.9 mg edetate disodium (2.4 mM), 0.3 mg $CaCl_2$ (2.7 mM) and NaOH to adjust the pH to 7.4. Other formulations of human soluble hyaluronidase, such as the rHuPH20 formulations described in U.S. Pat. Pub. No. US2011/0053247, include 130 mM NaCl, 10 mM Hepes, pH 7.0; or 10 mM histidine, 130 mM NaCl, pH 6.0.

Formulations of hyaluronan degrading enzymes, such as hyaluronidases, including a PH20 such as rHuPH20, contain different components than formulations of insulins. For example, PH20 is most stable at lower pH values between The fast-acting insulin formulations contain a preservative, which prevents microbial contamination being introduced into the formulation by repeated access, such as repeated insertion of a needle, for multiple dosing. Although many preservatives currently are used in approved parenteral drug products, phenolic compounds such as phenol, metacresol (m-cresol) and parabens are most commonly used in insulin formulations. These phenolic compounds serve not only as effective anti-microbial agents, but also can bind to allosteric sites on the insulin hexamer and change the overall conformation of the higher order structure of insulin. This stabilizes the hexamers by inhibiting the formation of filamentous aggregates (fibrils), which form more readily with insulin monomers than hexamers (Rahuel-Clermont et al. (1997) *Biochemistry* 36:5837-5845). Although these preservatives can act as stabilizers, they also can reduce solubility of the insulin if present at too high a concentration. Thus, the concentration of preservatives in insulin is critical to the stability and solubility of the agent.

One or more tonicity modifiers typically are included in the insulin formulations to adjust the isotonicity of the preparation. Exemplary tonicity modifiers that often are present in the insulin formulations include glycerin and/or NaCl. In addition to affecting isotonicity, NaCl affects the solubility of the insulin, such that an increase in NaCl concentration results in reduced solubility. Various insulins, including insulin analogs, have different apparent solubility. Thus, the amount of NaCl that can be present in the formulation without adversely affecting solubility will differ between insulins. For example, insulin glulisine (e.g. Apidra® insulin glulisine) is more soluble than insulin aspart (e.g. NovoLog® insulin aspart), and thus tolerates more NaCl in the formulation. By comparison, insulin lispro and regular insulin are the least soluble of the fast acting insulins and typically contain no NaCl in their formulations.

Other components also can be included in the insulin formulations. Many insulin formulations, including regular insulin, insulin aspart and insulin lispro formulations, contain $Zn^{2+}$ ions, which promote and stabilize hexamer formation. Although insulin glulisine formulations do not contain zinc, they do contain polysorbate 20 (P20; Tween 20) as a protein stabilizer. Buffers used in the fast acting insulin formulations can include, for example, dibasic sodium phosphate buffer and Trometamol (also known as Tris or THAM).

3. Hyaluronan-Degrading Enzyme and Insulin Co-Formulations

Compositions containing a fast-acting insulin and a hyaluronan degrading enzyme (such as a soluble hyaluronidase, e.g. rHuPH20) produce a super fast-acting insulin composition that more closely mimics the endogenous (i.e., natural) post-prandial insulin release of a nondiabetic subject compared to the fast-acting insulin alone (see e.g. U.S. Pub No. US20090304665). Thus, such super fast-acting insulin compositions can be used by diabetic subjects to more accurately control blood glucose levels and reduce hyperglycemic excursions, compared to fast-acting insulins alone, thereby providing a substantial benefit to the patient.

Multi-dose formulations of fast-acting insulins and formulations of hyaluronan degrading enzymes, however, are incompatible and the mixing of the two typically results in rapid loss of stability and activity of the hyaluronan degrading enzyme in addition to rapid loss of insulin solubility and stability. Until now, therefore, administration of a super fast-acting composition must be performed immediately after combining the insulin and the hyaluronan degrading enzyme to prevent loss of activity. This is impractical and an unacceptable burden for the diabetic patient.

Thus, provided herein are stable co-formulations of a fast-acting insulin and a hyaluronan degrading enzyme (such as a soluble hyaluronidase, e.g. rHuPH20). The co-formulations provided herein can be used as therapeutics for the treatment of diabetes mellitus, in particular for the control of post prandial blood glucose levels. The stable co-formulations include those that are multidose formulations that can be provided in a vial, syringe, pen, reservoir for a pump or in a closed loop system, or any other suitable container.

a. Opposing Requirements for Stability

Major barriers preventing the development of stable co-formulations of insulin and hyaluronan degrading enzymes, such as soluble hyaluronidases (e.g. rHuPH20), include the crystallization and precipitation of fast acting insulins at refrigerated temperatures, and the stability of the hyaluronan-degrading enzyme at elevated temperatures. Typically, the excipients and conditions that normally prevent such outcomes are different for the two active agents. Some excipients and conditions that are optimal for maintaining solubility and stability of insulin formulations can have a negative effect on the stability and activity of hyaluronan degrading enzymes, such as soluble hyaluronidases (e.g. rHuPH20). Conversely, the excipients and conditions that are optimal for stability of a hyaluronan degrading enzyme, such as a hyaluronidase for example a PH20 (e.g. rHuPH20) have a negative effect of the stability and solubility of insulins.

Merely mixing the existing formulations of insulin, including rapid-acting insulin analogs, and the existing formulations of soluble hyaluronidases, such as rHuPH20, results in a formulation that is not stable under long-term refrigerated storage, or storage at ambient temperature or elevated temperature. This is due to rapid aggregation of rHuPH20 and loss of enzymatic activity, as well as loss of insulin activity. These detrimental effects are the result of multiple incompatible excipients and conditions, including, but not limited to, the type and concentration of preservatives, NaCl concentration, zinc concentration, pH and storage temperature. Thus, identifying formulations in which both agents remain soluble, stable and active is extremely challenging.

i. Preservatives

Preservatives are included in multidose insulin formulations to prevent microbial contamination, which can be introduced into the formulation through repeated access to the vial, pen cartridge, or other multi-dose container containing the formulation. The preservatives typically must be present at sufficient concentrations to satisfy regulatory rules. For example, regulatory requirements assert that the antimicrobial efficacy of the formulation must satisfy the preservative efficacy test (PET) requirements of the target markets. The PET requirements of the United States Pharmacopoeia (USP) and the European Pharmacopoeia (EP) differ considerably, imposing additional constraints in developing multidose formulations.

Marketed insulin formulations typically contain phenol, meta-cresol (m-cresol) and/or methylparaben. These compounds not only serve as effective anti-microbial agents, but also can act to stabilize the hexameric forms of the insulin molecules. However, the concentration and type of preservative used in the insulin formulations is important. For example, although phenolic compounds can stabilize hexameric insulin molecules at optimal concentrations, the solubility of the insulin decreases as the concentration of the preservative increases. Thus, the concentration of preservative in the insulin formulations is critical for both stability and solubility, as well as providing essential anti-microbial activity.

Although a necessary component, preservatives pose a significant problem in the development of stable, multidose formulations of proteins because they typically induce aggregation of the protein in aqueous solution. For example, preservatives such as phenol, m-cresol, and benzyl alcohol have been shown to induce aggregation of human growth hormone (Maa and Hsu (1996) *Int. J. Pharm.* 140:155-168), recombinant interleukin-1 receptor (Remmele (1998) *Pharm. Res.* 15:200-208), human insulin-like growth factor I (Fransson (1997) *Pharm. Res.* 14:606-612), rhIFN-γ (Lam (1997) *Pharm. Res.* 14:725-729) and cytochrome c (Singh et al. (2011) *J. Pharm Sci.,* 100:1679-89). The destabilizing effect that preservatives have on proteins in solution has been a limiting factor in the development of multidose formulations, and to date, most protein therapeutics have been formulated for single use only.

Like most other protein therapeutics, PH20 hyaluronidase, such as rHuPH20, rapidly loses activity in the presence of preservatives, likely due to unfolding of the protein and subsequent aggregate formation. For example, as shown in the Examples herein, preservatives reduce PH20 enzymatic activity, particularly at elevated temperatures. The results herein show by dynamic light scattering (DLS), differential scanning calorimetry (DSC) and other physical chemical characterization techniques that the melting temperature of the exemplary hyaluronan-degrading enzyme rHuPH20 is reduced significantly when phenolic preservatives, such as m-cresol, are added to the formulation. For example, the unfolding temperature of rHuPH20 is reduced from 44° C. to 24° C. The lower PH20 unfolding temperature leads to increased PH20 aggregation, especially at elevated temperatures, and reduced enzyme activity.

As noted above, these phenolic compounds, such as phenol, m-cresol, and parabens, are the very preservatives used in insulin formulations. The destabilizing effect is likely due to the hydrophobic nature of the phenolic preservatives. The hydrophobicity of the phenolic compounds can lead to interaction with rHuPH20 through nonspecific binding to the protein, ultimately perturbing the structural integrity of rHuPH20. This translates to a significant loss of rHuPH20 enzymatic activity in the presence of preservatives.

As demonstrated in the Examples herein, as the level of phenolic preservative (e.g. phenol, m-cresol and methylparaben) increases, and/or the temperature increases, the negative impact on rHuPH20 enzymatic activity also increases. For example, the enzymatic activity of rHuPH20 was significantly reduced after one week of incubation at 35° C. when the overall preservative level is relatively high (>0.2%). At room temperature and lower preservative concentrations, the enzyme maintains its activity relatively well for at least one month. Further, the type of phenolic compound also impacts the activity of rHuPH20, such that m-cresol is the most detrimental to rHuPH20 activity, followed by phenol and then methylparaben. However, methylparaben, although the least detrimental to rHuPH20 activity of the phenolic compounds, is also the least effective as an anti-microbial, and thus not an optimal preservative. Other preservatives, such as thimerosal and chlorhexidine salts, appear more compatible with rHuPH20 but are not widely accepted. Thus, formulations that contain these nontraditional preservatives face additional regulatory hurdles.

The detrimental effect of preservatives on the exemplary hyaluronan-degrading enzyme rHuPH20 enzymatic activity is greatly enhanced at elevated temperatures. As shown in the Examples, phenolic preservatives have a negative effect on the melting temperature ($T_m$) of the enzyme. For example, the $T_m$ for rHuPH20 dropped from above 40° C. in the absence of preservative, down to about 26° C. in the presence of, for example, 0.25% m-cresol. Thus, the $T_m$ of rHuPH20 significantly decreases when preservative is added to rHuPH20 in solution. As a result, at elevated temperatures, the soluble hyaluronidase unfolds. As shown in the Examples, this denaturation and subsequent aggregation is reflected in the increased size of the rHuPH20 molecules in the presence of preservatives at elevated temperatures.

Hence, preservatives, although required for their antimicrobial activities and useful for their stabilizing effect on hexameric insulin, can have a deleterious effect on the stability and activity of hyaluronan degrading enzymes, such as rHuPH20, and on the solubility of insulin.

ii. NaCl and pH

Another particular challenge in developing stable co-formulations of insulin and hyaluronan degrading enzymes (e.g. rHuPH20) is the fact that the optimal pH and NaCl concentration ranges for insulin solubility are different than the optimal pH and NaCl concentration ranges for rHuPH20. For example, the solubility of insulin and insulin analogs tends to increase with a higher pH (e.g. >7.2) and lower NaCl concentration (e.g. <140 mM), conditions which typically have a deleterious effect on the stability of the exemplary hyaluronan-degrading enzyme rHuPH20, particularly at elevated temperatures and over long term storage. This difference is exacerbated even further in the presence of preservatives, which tend to reduce insulin solubility and rHuPH20 stability.

The apparent solubility of regular insulin and the rapid acting insulin analogs varies, with solubility increasing from regular insulin, which is the least soluble, to insulin lispro, then insulin aspart and finally insulin glulisine, which is the most soluble. The solubility is directly related to the tolerance for NaCl in the formulation, such that no NaCl is present in marketed solutions containing regular insulin and insulin lispro, a small amount of NaCl (10 mM) is present in marketed formulations of insulin aspart, and a larger amount of NaCl (85 mM) is present in marketed formulations of insulin glulisine.

Increasing the NaCl concentration of the insulin formulations can result in crystallization/aggregation of the insulin, particularly at lower temperatures. The solubility also is greatly affected by NaCl. As demonstrated in the Examples, when the NaCl concentration of refrigerated insulin solutions increased from 50 mM to 140 mM, the solubility of regular insulin, insulin aspart and insulin lispro decreased significantly. As demonstrated in the Examples, however, the opposite is true for the exemplary hyaluronan-degrading enzyme rHuPH20 stability. The stability of rHuPH20 in solution at elevated temperatures (e.g. 25° C. and 30° C.) is greatly reduced over time as the NaCl concentration is decreased from 140 mM to 50 mM.

The solubility of insulin also is greatly affected by pH. Similar to effects of higher concentrations of NaCl on insulin solubility, a similar negative effect on insulin solubility was observed by decreasing the pH from 7.6 to 6.6. Thus, at low pH and high NaCl, insulin solubility is greatly reduced. Conversely, insulin solubility is maximal at low NaCl and high pH. Similar to the opposite requirements of NaCl concentration between insulin and PH20, pH requirements also are opposite. The stability of rHuPH20 in solution at elevated temperatures (e.g. 25° C. and 30° C.) is greatly reduced over time as the pH is increased from 7.0 to 7.6. At refrigerated temperatures, rHuPH20 is relatively stable regardless of pH and NaCl concentration.

Thus, the optimal NaCl concentration and pH for insulin solubility and hyaluronan degrading enzyme (e.g. rHuPH20) stability appear incompatible. Insulin solubility is maximal at higher pH and lower NaCl concentration. These conditions, however, are detrimental to the exemplary hyaluronan-degrading enzyme rHuPH20, which loses stability at higher pH and lower NaCl concentration. The stability of rHuPH20 can be increased by increasing NaCl concentrations and lowering pH. However, such conditions have a negative effect of the solubility of insulin and insulin analogs, which precipitate at low pH and high NaCl concentration. Hence, one of the major challenges to the development of stable co-formulations of insulin and a hyaluronan degrading enzymes (e.g. rHuPH20 or other hyaluronan-degrading enzyme) is identifying an NaCl concentration and pH in which insulin remains soluble and active and the hyaluronan-degrading enzyme (e.g. rHuPH20) remains stable and active. This has been achieved herein.

b. Compatible Co-Formulation

The opposing requirements of insulin and hyaluronidase, such as PH20 hyaluronidase, for stability mean that several parameters must be balanced to optimize compatibility in a co-formulation. The stable co-formulations provided herein contain the required balance of preservatives, salt (e.g. NaCl), pH, stabilizer(s), and/or buffer to retain acceptable levels of hyaluronan degrading enzyme activity and insulin solubility and activity. As discussed above, the challenges in identifying this balance were several-fold. In the first instance, preservatives, such as phenolic preservatives, which are required as anti-bacterials in multidose formulations, have significant destabilizing effects on hyaluronan degrading enzymes, such as rHuPH20, resulting in rapid loss of activity. Secondly, the optimal NaCl concentrations and pH for insulin solubility and stability are very different to those for stability of hyaluronan degrading enzymes. Insulin solubility is maximal at higher pH and lower NaCl concentration. These conditions, however, are detrimental to the exemplary hyaluronan-degrading enzyme rHuPH20, which loses stability at higher pH and lower salt concentration. This instability of rHuPH20 is exacerbated even further in the presence of preservatives. The stability of rHuPH20 can be increased by increasing NaCl concentrations and lowering pH. However, such conditions have a negative effect on the solubility of insulin and insulin analogs, which precipitate at low pH and high salt concentration.

Thus, identifying conditions under which both the hyaluronan degrading enzyme and the fast-acting insulin remain soluble, stable and active is extremely challenging. The co-formulations provided herein nonetheless provide these conditions. Not only are optimal salt (e.g. NaCl), pH and preservative combinations identified, but additional stabilizers and buffers also are identified that, when combined with each other and, in some instances, the described salt, pH and preservatives, further stabilize the hyaluronan degrading enzyme and insulin as well as maintain solubility of the insulin. For example, it is found herein that Lys-Lys is a stabilizer that in some cases, and with some insulin analogs, can be used as a substitute for NaCl such that no or lower concentrations of NaCl can be used in the formulation while retaining enzyme activity and insulin solubility.

The following sections describe exemplary hyaluronan-degrading enzymes and insulins for inclusion in the formulations or co-formulations, exemplary stable formulations and co-formulations, methods of assessing the stability and activity of formulations and co-formulations, and methods of using the formulations or co-formulations in various diseases and conditions.

C. HYALURONAN DEGRADING ENZYMES

Provided herein are stable formulations of a hyaluronan-degrading enzyme. Also provided herein are stable co-formulations containing an insulin and a hyaluronan-degrading enzyme. For example, the description and examples herein show that stable co-formulations of an insulin and a hyaluronan-degrading enzyme, such as a hyaluronidase, can be made even though each individually has opposing requirements for stability and activity. This is exemplified herein with PH20 (e.g. rHuPH20), but can be generalized to other hyaluronan-degrading enzymes, such as soluble hyaluronidases or other PH20 polypeptides.

In particular, provided herein are formulations or co-formulations containing a hyaluronan-degrading enzyme that is a hyaluronidase such as a truncated hyaluronidase (e.g. C-terminally truncated) lacking all or a portion of a GPI anchor motif. Such hyaluronidase polypeptides can be recombinantly expressed and secreted from cells into the media upon expression therefrom. By virtue of secretion into the media, hyaluronidases that are normally associated with the cell membrane, when truncated, can exist as soluble protein products. It is within the level of one of skill int the art to generate and/or express hyaluronan-degrading enzymes as provided herein or known in the art, and make stable formulations or co-formulations based on the description and teachings herein.

Hyaluronan-degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating $\beta$-1→4 and $\beta$-1→3 glycosidic bonds. Hyaluronan chains can reach about 25,000 disaccharide repeats or more in length and polymers of hyaluronan can range in size from about 5,000 to 20,000,000 Da in vivo. Hyaluronan, also called hyaluronic acid or hyaluronate, is a non-sulfated glycosaminoglycan that is widely distributed throughout connective, epithelial, and neural tissues. Hyaluronan is an essential component of the extracellular matrix and a major constituent of the interstitial barrier. By catalyzing the hydrolysis of hyaluronan, hyaluronan-degrading enzymes lower the viscosity of hyaluronan, thereby increasing tissue permeability and increasing the absorption rate of fluids administered parenterally. As such, hyaluronan-degrading enzymes, such as hyaluronidases, have been used, for example, as spreading or dispersing agents in conjunction with other agents, drugs and proteins to enhance their dispersion and delivery.

Accordingly, hyaluronan-degrading enzymes include any enzyme having the ability to catalyze the cleavage of a hyaluronan disaccharide chain or polymer. In some examples the degrading enzyme cleaves the $\beta$-1→4 glycosidic bond in the hyaluronan chain or polymer. In other examples, the degrading enzyme catalyze the cleavage of the $\beta$-1→3 glycosidic bond in the hyaluronan chain or polymer. Exemplary of hyaluronan degrading enzymes in the co-formulations provided herein are hyaluronidases that are secreted into the media when expressed from a cell expression system, including natural hyalurondiases that do not contain a glycosylphosphatidylinositol (GPI) anchor or truncated hyaluronidases that lack one or more amino acids of the GPI anchor or hyaluronidases that are otherwise not associated with the cell membrane when expressed therefrom. Such hyaluronidases can be produced recombinantly or synthetically. Other exemplary hyaluronan degrading enzymes include, but are not limited to particular chondroitinases and lyases that have the ability to cleave hyaluronan.

Hyaluronan-degrading enzymes provided in the co-formulations herein also include allelic or species variants or other variants, of a hyaluronan-degrading enzyme as described herein. For example, hyaluronan-degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein).

Various forms of hyaluronan degrading enzymes, including hyaluronidases have been prepared and approved for therapeutic use in subjects, including humans. For example, animal-derived hyaluronidase preparations include Vitrase® (ISTA Pharmaceuticals), a purified ovine testicular hyaluronidase, and Amphadase® (Amphastar Pharmaceuticals), a bovine testicular hyaluronidase. Hylenex® (Baxter) is a human recombinant hyaluronidase produced by genetically engineered Chinese Hamster Ovary (CHO) cells containing nucleic acid encoding a truncated human PH20 polypeptide (designated rHuPH20). It is understood that any hyaluronan-degrading enzyme, such as any hyaluronidase can be included in the stable co-formulations provided herein (see, e.g., U.S. Pat. No. 7,767,429, and U.S. Publication Nos. 20040268425 and 20100143457, which are incorporated by reference in their entirety).

Typically, for use in the formulations and co-formulations herein, a human hyaluronan degrading enzyme, such as a human PH20 and in particular a C-terminal truncated human PH20 as described herein, is used. Although hyaluronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, they can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the formulations and co-formulations provided herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

1. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the co-formulations provided herein.

a. Mammalian-Type Hyaluronidases

Mammalian-type hyaluronidases (EC 3.2.1.35) are endo-β-N-acetylhexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:10, 11 and 64 and BH55 (U.S. Pat. Nos. 5,747,027 and 5,827,721)), sheep (*Ovis aries*) (SEQ ID NO: 26, 27, 63 and 65), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), orangutan (SEQ ID NO:28), cynomolgus monkey (SEQ ID NO:29), guinea pig (SEQ ID NO:30), chimpanzee (SEQ ID NO:185), rhesus monkey (SEQ ID NO:186) and human hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NO:27), bovine (SEQ ID NO:11) and human (SEQ ID NO:1). Human PH20 (also known as SPAM1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid. Exemplary of hyaluronidases used in the co-formulations here are neutral active hyaluronidases.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova, et al. (2003) *Proc Natl Acad Sci USA* 100(8): 4580-5), and those which are generally soluble such as human HYAL1 (Frost et al. (1997) *Biochem Biophys Res Commun.* 236(1):10-5).

PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. They have both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO: 2), bovine (SEQ ID NOS: 11 and 64), rabbit (SEQ ID NO: 25), ovine PH20 (SEQ ID NOS: 27, 63 and 65), cynomolgus monkey (SEQ ID NO: 29), guinea pig (SEQ ID NO: 30), rat (SEQ ID NO: 31), mouse (SEQ ID NO: 32), chimpanzee (SEQ ID NO: 185) and rhesus monkey (SEQ ID NO:186) PH20 polypeptides.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost G I (2007) *Expert Opin. Drug. Deliv.* 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-36). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 is, therefore, a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Although human PH20 is a neutral active hyaluronidase when it exists at the plasma membrane via a GPI anchor, it exhibits activity at both neutral and acidic pH when it is expressed on the inner acrosomal membrane. It appears that PH20 contains two catalytic sites at distinct regions of the polypeptide: the Peptide 1 and Peptide 3 regions (Cherr et al., (2001) *Matrix Biology* 20:515-525). The Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) *Eur. J. Biochem.* 247:810-814).

The Peptide 3 region, which corresponds to amino acid positions 242-262 of the mature polypeptide set forth in SEQ ID NO:2, and of positions 277-297 of the precursor polypeptide set forth in SEQ ID NO:1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) *Eur. J. Biochem.* 247:810-814).

In addition to the catalytic sites, PH20 also contains a hyaluronan-binding site. Experimental evidence shows that this site is located in the Peptide 2 region, which corresponds to amino acid positions 205-235 of the precursor polypeptide set forth in SEQ ID NO:1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) *Eur. J. Biochem.* 247:810-814).

There are seven potential N-linked glycosylation sites in human PH20 at N82, N166, N235, N254, N368, N393, N490 of the polypeptide exemplified in SEQ ID NO:1. Because amino acids 36 to 464 of SEQ ID NO:1 appears to contain the minimally active human PH20 hyaluronidase domain, the N-linked glycosylation site N-490 is not required for proper hyaluronidase activity. There are six disulfide bonds in human PH20. Two disulfide bonds between the cysteine residues C60 and C351 and between C224 and C238 of the polypeptide exemplified in SEQ ID NO:1 (corresponding to residues C25 and C316, and C189 and C203 of the mature polypeptide set forth in SEQ ID NO:2, respectively). A further four disulfide bonds are formed between the cysteine residues C376 and C387; between C381 and C435; between C437 and C443; and between C458 and C464 of the polypeptide exemplified in SEQ ID NO:1 (corresponding to residues C341 and C352; between C346 and C400; between C402 and C408; and between C423 and C429 of the mature polypeptide set forth in SEQ ID NO:2, respectively).

b. Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for co-formulations provided herein include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides*, and *Streptomyces*. Particular examples of such enzymes include, but are not limited to *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73)), *Staphylococcus aureus* (strain COL) (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ESI 14 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607).

c. Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→6-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

2. Other Hyaluronan Degrading Enzymes

In addition to the hyaluronidase family, other hyaluronan degrading enzymes can be used in the stable formulations provided herein or the co-formulations with insulin provided herein. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7): 1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272:9123-9130). A exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 98 (Sato et al. (1994) *Appl. Microbiol. Biotechnol.* 41(1): 39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133)

3. Truncated Hyaluronan Degrading Enzymes or Other Soluble Forms

Hyaluronan-degrading enzymes can exist in membrane-bound or membrane-associated form, or can be secreted into the media when expressed from cells and thereby exist in soluble form. For purposes herein, hyaluronan degrading enzymes include any hyaluronan degrading enzymes that when expressed and secreted from cells are not associated with the cell membrane, and thereby exist in soluble form. Soluble hyaluronan-degrading enzymes include, but are not limited to hyaluronidases, including non-human hyaluronidases (e.g. animal or bacterial hyaluronidases), such as bovine PH20 or ovine PH20, and human hyaluronidases such as Hyal1, or truncated forms of non-human or human membrane-associated hyaluronidases, in particular truncated forms of human PH20, allelic variants thereof and other variants thereof. Exemplary of hyaluronan-degrading enzymes in the co-formulations herein are truncated forms of a hyaluronan-degrading enzyme that lack one or more amino acid residues of a glycosylphosphatidylinositol (GPI) anchor and that retain hyaluronidase activity. In one example, the human hyaluronidase PH20, which is normally membrane anchored via a GPI anchor, can be made soluble by truncation of and removal of all or a portion of the GPI anchor at the C-terminus.

Thus, in some instances, a hyaluronan degrading enzyme that is normally GPI-anchored (such as, for example, human PH20) is rendered soluble by truncation at the C-terminus. Such truncation can remove all of the GPI anchor attachment signal sequence, or can remove only some of the GPI anchor attachment signal sequence. The resulting polypeptide, however, is soluble. In instances where the soluble hyaluronan degrading enzyme retains a portion of the GPI anchor attachment signal sequence, 1, 2, 3, 4, 5, 6, 7, 8, 9, 10 or more amino acid residues in the GPI-anchor attachment signal sequence can be retained, provided the polypeptide is soluble (i.e. secreted when expressed from cells)

and active. One of skill in the art can determine whether a polypeptide is GPI-anchored using methods well known in the art. Such methods include, but are not limited to, using known algorithms to predict the presence and location of the GPI-anchor attachment signal sequence and ω-site, and performing solubility analyses before and after digestion with phosphatidylinositol-specific phospholipase C (PI-PLC) or D (PI-PLD).

Exemplary of a soluble hyaluronidase is PH20 from any species, such as any set forth in any of SEQ ID NOS: 1, 2, 11, 25, 27, 30-32, 63-65 and 185-186, or truncated forms thereof lacking all or a portion of the C-terminal GPI anchor, so long as the hyaluronidase is soluble and retains hyaluronidase activity. Exemplary soluble hyaluronidases that are C-terminally truncated and lack all or a portion of the GPI anchor attachment signal sequence include, but are not limited to, PH20 polypeptides of primate origin, such as, for example, human and chimpanzee PH20 polypeptides. For example, soluble PH20 polypeptides can be made by C-terminal truncation of any of the mature or precursor polypeptides set forth in SEQ ID NOS:1, 2 or 185, or allelic or other variation thereof, including active fragment thereof, wherein the resulting polypeptide is soluble and lacks all or a portion of amino acid residues from the GPI-anchor attachment signal sequence. Also included among soluble hyaluronidases are allelic variants or other variants of any of SEQ ID NOS: 1, 2, 11, 25, 27, 30-32, 63-65 and 185-186, or truncated forms thereof. Allelic variants and other variants are known to one of skill in the art, and include polypeptides having 60%, 70%, 80%, 90%, 91%, 92%, 93%, 94%, 95%, 96%, 97%, 98% or more sequence identity to any of SEQ ID NOS: 1, 2, 11, 25, 27, 30-32, 63-65 and 185-186, or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

a. C-Terminal Truncated Human PH20

Exemplary of a soluble hyaluronidase is a C-terminal truncated human PH20. C-terminal truncated forms of recombinant human PH20 have been produced and can be used in the co-formulations described herein. The production of such soluble forms of PH20 is described in U.S. Pat. No. 7,767,429 and U.S. Pat. Application Nos. US20040268425, US20050260186, US20060104968 and US20100143457.

For example, C-terminal truncated PH20 polypeptides include polypeptides that at least contain amino acids 36-464 (the minimal portion required for hyaluronidase activity), or include a sequence of amino acids that has at least 85%, for example at least 86%, 87%, 88%, 89%, 90%, 91%, 92%, 93%, 94%, 95%, 96%, 97%, 98% sequence identity to a sequence of amino acids that includes at least amino acids 36-464 of SEQ ID NO:1 and retain hyaluronidase activity. Included among these polypeptides are human PH20 polypeptides that completely lack all the GPI-anchor attachment signal sequence. Also include among these polypeptides are human PH20 polypeptides that lack a portion of contiguous amino acid residues of the GPI-anchor attachment signal sequence (termed extended soluble PH20 (esPH20); see e.g. US20100143457). C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS:1 or 2, or allelic or species variants or other variants thereof. Thus, instead of having a GPI-anchor covalently attached to the C-terminus of the protein in the ER and being anchored to the extracellular leaflet of the plasma membrane, these polypeptides are secreted when expressed from cells and are soluble.

Exemplary C-terminally truncated human PH20 polypeptides provided herein include any that include at least amino acids 36-464 of SEQ ID NO:1 and are C-terminally truncated after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1, or a variant thereof that exhibits at least 85% sequence identity, such as at least 86%, 87%, 88%, 89%, 90%, 91%, 92%, 93%, 94%, 95%, 96%, 97%, 98% sequence identity thereto and retains hyaluronidase activity. Table 3 provides non-limiting examples of exemplary C-terminally truncated PI-120 polypeptides. In Table 3 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 3 for comparison. For example, exemplary C-terminally truncated PH20 polypeptides include, but are not limited to, polypeptides set forth in any one of SEQ ID NOS: 4-9, 47-48, 234-254, and 267-273, or a polypeptide that exhibits at least 70%, 75%, 80%, 85%, 86%, 87%, 88%, 89%, 90%, 91%, 92%, 93%, 94%, 95%, 96%, 97%, 98%, 99% or more sequence identity to any one of SEQ ID NOS: 4-9, 47-48, 234-254, and 267-273.

TABLE 3

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-SILF | 500 | 223 | 465 | 267 |
| SPAM-VSIL | 499 | 190 | 464 | 234 |
| SPAM1-IVSI | 498 | 224 | 463 | 268 |
| SPAM1-FIVS | 497 | 191 | 462 | 235 |
| SPAM1-MFIV | 496 | 225 | 461 | 269 |
| SPAM1-TMFI | 495 | 192 | 460 | 236 |
| SPAM1-ATMF | 494 | 226 | 459 | 270 |
| SPAM1-SATM | 493 | 193 | 458 | 237 |
| SPAM1-LSAT | 492 | 227 | 457 | 271 |
| SPAM1-TLSA | 491 | 194 | 456 | 238 |
| SPAM1-STLS | 490 | 196 | 455 | 240 |
| SPAM1-PSTL | 489 | 195 | 454 | 239 |
| SPAM1-SPST | 488 | 228 | 453 | 272 |
| SPAM1-ASPS | 487 | 197 | 452 | 241 |
| SPAM1-NASP | 486 | 229 | 451 | 273 |
| SPAM1-YNAS | 485 | 198 | 450 | 242 |
| SPAM1-FYNA | 484 | 199 | 449 | 243 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |

TABLE 3-continued

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| SPAM1-TEEP | 478 | 42 | 443 | 8 |
| SPAM1-ETEE | 477 | 41 | 442 | 9 |
| SPAM1-METE | 476 | 200 | 441 | 244 |
| SPAM1-PMET | 475 | 201 | 440 | 245 |
| SPAM1-PPME | 474 | 202 | 439 | 246 |
| SPAM1-KPPM | 473 | 203 | 438 | 247 |
| SPAM1-LKPP | 472 | 204 | 437 | 248 |
| SPAM1-FLKP | 471 | 205 | 436 | 249 |
| SPAM1-AFLK | 470 | 206 | 435 | 250 |
| SPAM1-DAFL | 469 | 207 | 434 | 251 |
| SPAM1-IDAF | 468 | 208 | 433 | 252 |
| SPAM1-CIDA | 467 | 40 | 432 | 47 |
| SPAM1-VCID | 466 | 209 | 431 | 253 |
| SPAM1-GVCI | 465 | 200 | 430 | 254 | b. rHuPH20

Exemplary of a C-terminal truncated form of SEQ ID NO:1 is a polypeptide thereof that is truncated after amino acid 482 of the sequence set forth in SEQ ID NO:1. Such a polypeptide can be generated from a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS:4-9 in various abundance. Typically, rHuPH20 is produced in cells that facilitate correct N-glycosylation to retain activity, such as CHO cells (e.g. DG44 CHO cells).

4. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man)$_3$-GlcNAc-GlcNAc-cores attached via the amide nitrogen of Asn residues that fall within -Asn-Xaa-Thr/Ser-sequences (where Xaa is not Pro). Glycosylation at an -Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are seven potential N-linked glycosylation sites at N82, N166, N235, N254, N368, N393, N490 of human PH20 exemplified in SEQ ID NO: 1. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, N-linked glycosylation at N490 is not required for hyaluronidase activity.

In some examples, the hyaluronan degrading enzymes for use in the co-formulations provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO:1 are glycosylated. In some examples the hyaluronan degrading enzymes are glycosylated at one or more native glycosylation sites. Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes, such as a PH20 or human PH20, included in the co-formulations provided herein are partially deglycosylated (or N-partially glycosylated polypeptides) (see e.g. U.S. Pat. Publication No. US20100143457). Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. For example, treatment of PH20 (e.g. a recombinant PH20 designated rHuPH20) with one or all of the above glycosidases (e.g. EndoF1, EndoF2 EndoF3 and/or EndoH) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, or with the GlcNAc phosphotransferase (GPT) inhibitor tunicamycin, results in complete deglycosylation of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO:1) can be glycosylated, treatment with one or more glycosidases can render the extent of glycosylation reduced compared to a hyaluronidase that is not digested with one or more glycosidases.

Hence, partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. In one example, 1, 2, 3, 4, 5 or 6 of the N-glycosylation sites corresponding to amino acids N82, N166, N235, N254, N368, and N393 of SEQ ID NO:1 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO:1 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO:1 are glycosylated. Glycosylated amino acid residues minimally contain an N-acetylglucosamine moiety. Typically, the partially deglycosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

5. Modifications of Hyaluronan Degrading Enzymes to Improve their Pharmacokinetic Properties Hyaluronan degrading enzymes can be modified to improve their pharmacokinetic properties, such as increasing their half-life in vivo and/or activities. The modification of hyaluronan degrading enzymes for use in the stable formulations or co-formulations provided herein or in any compositions, combinations and/or methods provided can include attaching, directly or indirectly via a linker, such as covalently or by other stable linkage, a polymer, such as dextran, a polyethylene glycol (pegylation (PEG)) or sialyl moiety, or other such polymers, such as natural or sugar polymers.

Pegylation of therapeutics is known to increase resistance to proteolysis, increase plasma half-life, and decrease antigenicity and immunogenicity. Covalent or other stable attachment (conjugation) of polymeric molecules, such as polyethylene glycol moiety (PEG), to the hyaluronan degrading enzyme thus can impart beneficial properties to the resulting enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, include natural and synthetic homopolymers, such as polyols (i.e. poly-OH), polyamines (i.e. poly-NH$_2$) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polypropylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran, pullulan and the like, have few reactive groups capable of cross-linking. Typically, the polymers are non-toxic polymeric molecules such as (m)polyethylene glycol (mPEG) which can be covalently conjugated to the hyaluronan degrading enzyme (e.g., to attachment groups on the protein surface) using relatively simple chemistry.

Suitable polymeric molecules for attachment to the hyaluronan degrading enzyme include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., Advanced Drug Delivery Review 2002, 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.*, 3(1):125-136, 2000; Harris, *Nature Reviews Drug Discovery* 2:214 (2003); and Tsubery, *J Biol. Chem* 279(37):38118-24, 2004). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

Various methods of modifying polypeptides by covalently attaching (conjugating) a PEG or PEG derivative (i.e. "PEGylation") are known in the art (see e.g., U.S. Pat. Pub. Nos. 20060104968 and U.S. 20040235734; U.S. Pat. No. 5,672,662 and U.S. Pat. No. 6,737,505). Techniques for PEGylation include, but are not limited to, specialized linkers and coupling chemistries (see e.g., Roberts, *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002) (see, also, for example, Lu and Felix (1994) *Int. J. Peptide Protein Res.* 43:127-138; Lu and Felix (1993) *Peptide Res.* 6:140-6, 1993; Felix et al. (1995) *Int. J. Peptide Res.* 46:253-64; Benhar et al. (1994) *J. Biol. Chem.* 269:13398-404; Brumeanu et al. (1995) *J Immunol.* 154:3088-95; see also, Caliceti et al. (2003) *Adv. Drug Deliv. Rev.* 55(10): 1261-77 and Molineux (2003) *Pharmacotherapy* 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see e.g., U.S. Pat. Pub. No. 20060104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butyraldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. 5,324, 844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/156047; U.S. 2003/0114647; U.S. 2003/0143596; U.S. 2003/0158333; U.S. 2003/0220447; U.S. 2004/0013637; US 2004/0235734; U.S. 2005/0114037; U.S. 2005/0171328; U.S. 2005/0209416; EP 01064951; EP 0822199; WO 00176640; WO 0002017; WO 0249673; WO 05000360; WO 9428024; and WO 0187925).

D. STABLE HYALURONAN-DEGRADING ENZYME FORMULATIONS

Provided herein are stable formulations of a hyaluronan-degrading enzyme containing a stabilizing excipient that is a divalent cation. Examples of divalent cations include, but are not limited to, lysyl-lysine (dilysine; Lys-Lys) or magnesium (e.g. $MgCl_2$), or salts, derivatives, analogues or mimetics thereof. In particular examples, the stable formulations of a hyaluronan-degrading enzyme contains Lys-Lys, or salts, derivatives, analogues or mimetics thereof, as a stabilizing excipient. In other examples, the stable formulations of a hyaluronan-degrading enzyme contain $MgCl_2$, or derivatives, analogues or mimetics thereof, as a stabilizing agent. Hyaluronan-degrading enzymes containing a divalent cation, for example Lys-Lys or $MgCl_2$, are stable at temperatures of greater than or equal to 37° C. for at least three (3) days, and generally at least six days, 7 days (one week), two weeks, three weeks or four weeks (one month). For example, such formulations are stable at temperatures of greater than or equal to 37° C. to 42° C., such as at least or approximately or about 40° C., for at least one months, two months, three months, four months, five months, six months, seven months, eight months, nine months, ten months, eleven months, twelve months or more.

Existing formulations of hyaluronan-degrading enzymes contain human serum albumin (HSA) as a stabilizer. For example, Hylenex® recombinant contains 1.0 mg human albumin. Stable HSA-free hyaluronan-degrading enzyme formulations are desired for several reasons. First, HSA is a blood derived product, and thus it often is not pure. Degradants and contaminants of HSA can interfere with activity of the enzyme. In addition, HSA itself also is subject to stability challenges, since it can form aggregates under certain conditions. It is found herein that stable HSA-free formulations of a hyaluronan-degrading enzyme, for example a hyaluronidase such as a PH20, can be made by inclusion of a divalent cation, for example, Lys-Lys.

Also, as discussed elsewhere herein, most existing formulations of a hyaluronan-degrading enzyme, for example a hyaluronidase such as PH20, also contain NaCl as a stabilizing agent. The presence of NaCl at high amounts of between or about between 130 mM to 150 mM NaCl or higher is generally required for optimal activity and stability of the enzyme. For example, the commercial PI-120 formulation Hylenex® contains 145 mM NaCl. As demonstrated in the examples herein, the divalent cation Lys-Lys and $MgCl_2$ exhibit stability effects on the exemplary hyaluronan-degrading enzyme PH20 that is improved over NaCl. This is advantageous, since it is found herein that NaCl does not efficiently stabilize PH20 upon incubation at elevated or accelerated temperatures of greater than 37° C. (see e.g. Examples 23 and 24). In contrast, the activity of PH20 in formulations containing divalent cations, such as Lys-Lys, is retained at elevated temperatures, such that formulations can exhibit up to 70% or more of activity, and generally at least or about at least 80%, 85%, 90%, or more activity, after incubation for 4 weeks at temperatures of greater than or equal to 37° C., such as greater than or equal to 37° C. to 42° C., such as at least or approximately or about 40° C., for at least one month. In examples of formulations herein containing a divalent cation as a stabilizer, for example Lys-Lys, the activity of the hyaluronan-degrading enzyme at elevated temperatures of at least or about at least 38° C. to 42° C., and in particular at 40° C., is increased by greater than or at least 10%, 20%, 30%, 40%, 50%, 60%, 70%, 80%, 90% or more compared to the activity of a hyaluronan-degrading enzyme that does not contain the divalent cation (e.g. contains NaCl as a stabilizing agent).

Provided herein are stable hyaluronan-degrading enzyme formulations that contain a therapeutically effective amount of a hyaluronan-degrading enzyme, such as a hyaluronidase for example a PH20 (e.g. rHuPH20) and an amount of a divalent cation, such as Lys-Lys or $MgCl_2$, to render the formulation stable at temperatures of greater than or equal to 37° C. for at least one month. In particular examples, provided herein are stable hyaluronan-degrading enzyme formulations that contain a therapeutically effective amount of a hyaluronan-degrading enzyme, such as a hyaluronidase for example a PH20 (e.g. rHuPH20) and an amount of Lys-Lys to render the formulation stable at temperatures of greater than or equal to 37° C. for at least one month. For example, such formulations are stable at temperatures of greater than or equal to 37° C. to 42° C., such as at least or approximately or about 40° C., for at least one month. The formulations generally also contain a surfactant, an anti-oxidation agent (e.g. methionine), a pH of between or about between 6.5 to 7.8 and a buffering agent that maintains the pH range. Optionally, the formulations can contain one or more other stabilizing agents, tonicity modifiers, preservative(s) or excipients.

Typically, the compounds are formulated into pharmaceutical compositions using techniques and procedures well known in the art (see e.g., Ansel *Introduction to Pharmaceutical Dosage Forms*, Fourth Edition, 1985, 126). Pharmaceutically acceptable compositions are prepared in view of approvals for a regulatory agency or other agency prepared in accordance with generally recognized pharmacopeia for use in animals and in humans. The formulation should suit the mode of administration.

The stable formulations can be provided as a pharmaceutical preparation in liquid form as solutions, syrups or suspensions. In liquid form, the pharmaceutical preparations can be provided as a concentrated preparation to be diluted to a therapeutically effective concentration before use. Generally, the preparations are provided in a dosage form that does not require dilution for use, i.e. formulations for direct administration. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use. The formulations can be prepared as single dose or multiple dose formulations.

The volume of the formulations provided herein can be any volume suitable for the container in which it is provided. In some examples, the formulations are provided in a vial, syringe, or any other suitable container. For example, the stable formulations provided herein are between or about between 0.1 mL to 500 mL, such as 0.1 mL to 100 mL, 1 mL to 100 mL, 0.1 mL to 50 mL, such as at least or about at least or about or 0.1 mL, 1 mL, 2 mL, 3 mL, 4 mL, 5 mL, 10 mL, 15 mL, 20 mL, 30 mL, 40 mL, 50 mL or more.

Provided below is a description of the components that are provided in the stable hyaluronan-degrading enzyme formulations herein. The following stable formulations are exemplary only and provide a platform from which minor adjustments can be made. It is understood that very small changes in the concentrations of the various excipients and other components (e.g. ±15% of the stated concentrations), or small changes in pH, can be made while retaining some if not all of the hyaluronan degrading enzyme stability. Further changes also can be made by adding or removing excipients. For example, the type of stabilizing surfactant can be changed.

1. Hyaluronan-Degrading Enzyme

The amount of hyaluronan degrading enzyme, such as a hyaluronidase for example a PH20 (e.g. rHuPH20), in the stable formulations provided herein is an amount for direct administration sufficient to achieve a therapeutic effect. In one example, the amount is an amount for direct administration sufficient to degrade hyaluronic acid (HA) in the subcutaneous space beneath the outer surface of the human skin. For example, the amount of hyaluronan-degrading enzyme in the formulation is an amount for direct administration to increase the dispersion and absorption of a co-injected or co-administered therapeutic agent. In another example, the amount is an amount for direct administration sufficient to degrade hyaluronic aid (HA) that is associated with a diseased tissue or cell. For example, the amount is an amount for direct administration sufficient to degrade HA associated with tumor cells. In such examples, the amount is an amount to decrease or lower the interstitial fluid pressure (IFP) or increase tumor vascular volume.

For example, the amount is functionally equivalent to at least or about at least 30 Units/mL. For example, the formulations provided herein contain a hyaluronan-degrading enzyme, such as a hyaluronidase for example a PH20 (e.g. rHuPH20) in an amount between or about between 30 Units/mL to 20,000 U/mL, 300 U/mL to 15,000 U/mL, 300 U/mL to 10,000 U/mL, 300 U/mL to 5,000 U/mL, 300 U/mL to 3000 U/mL, 300 U/mL to 2000 U/mL, 600 U/mL to 20,000 U/mL, 600 U/mL to 15,000 U/mL, 600 U/mL to 10,000 U/mL, 600 U/mL to 6000 U/mL, 600 U/mL to 4000 U/mL, 600 U/mL to 2000 U/mL, 600 U/mL to 1000 U/mL, 60 U/mL to 600 U/mL, or 100 U/mL to 300 U/mL, such as at least or about at least 30 U/mL, 35 U/mL, 40 U/mL, 50 U/mL, 100 U/mL, 200 U/mL, 300 U/mL, 400 U/mL, 500 U/mL, 600 U/mL, 700 U/mL, 800 U/mL, 900 U/mL, 1000 U/ml, 2000 U/mL, 3000 U/mL, 4000 U/mL, 5000 U/mL, 6000 U/mL, 7000 U/mL, 8000 U/mL, 9000 U/mL, 10,000 U/mL, 12,000 U/mL, 15,000 U/mL or 20,000 U/mL. For example, the formulations provided herein contain a PH20 (e.g. rHuPH20) that is in an amount that is at least 100 U/mL to 300 U/mL, for example at least or about at least or about or 100 U/mL, 115 U/mL, 120 U/mL, 125 U/mL, 130 U/mL, 135 U/mL, 140 U/mL, 145 U/mL, 150 U/mL, 155 U/mL, 160 U/mL, 165 U/mL, 170 U/mL, 175 U/mL, 180 U/mL, 185 U/mL, 190 U/mL, 200 U/mL, 220 U/mL, 240 U/mL, 260 U/mL, 280 U/mL or 300 U/mL.

In the stable formulations provided herein the stability of a hyaluronan-degrading enzyme, including a hyaluronidase such as a PH20 (e.g. rHuPH20), in the formulations is a function of the recovery and/or activity of the enzyme at elevated temperatures of greater than or equal to 37° C. to 42° C., such as at least or approximately or about 37° C. or 40° C., for at least three (3) days, and generally at least one month as described above. Assays to assess these parameters are described herein. The formulations provided herein retain hyaluronidase recovery and/or activity such that the formulations are suitable for therapeutic use as described herein. In the stable formulations provided herein, the activity of the hyaluronan degrading enzyme, such as a hyaluronidase, for example a PH20, typically is greater than or about 50%, such as greater than or at least 55%, 60%, 65%, 70%, 80%, 90%, 91%, 92%, 93%, 94%, 95%, 96%, 97%, 98%, 99% or more of the initial activity of enzyme in the formulation prior to exposure to temperatures of greater than or equal to 37° C. to 42° C. for at least three (3) days, and generally at least one month as described herein. For example, the activity of the hyaluronan-degrading enzyme, such as a hyaluronidase, for example a PH20, typically is greater than or about 50%, such as greater than or at least 55%, 60%, 65%, 70%, 80%, 90%, 91%, 92%, 93%, 94%, 95%, 96%, 97%, 98%, 99% of the activity of the same enzyme formulation when stored at 4° C. for at least one month. Typically, the stable hyaluronan-degrading enzyme formulations provided herein exhibit at least 70% of the initial activity of the enzyme for at least one month under storage or use at temperatures of greater than or equal to 37° C. to 42° C., such as at least or approximately or about 37° C. or 40° C. Thus, for example, in a solution formulated with 600 U/mL of a hyaluronan-degrading enzyme, for example rHuPH20, at least or about at least 360 Units/mL, 365 U/mL, 370 U/mL, 375 U/mL, 380 U/mL, 390 U/mL, 420 U/mL, 480 U/mL, 540 U/mL, 546 U/mL, 552 U/mL, 558 U/mL, 564 U/mL, 570 U/mL, 576 U/mL, 582 U/mL, 588 U/mL, 594 U/mL or more activity is retained at temperatures of greater than or equal to 37° C. to 42° C., such as at least or approximately or about 37° C. or 40° C., for at least one month. In other examples, stability can be assessed as function of recovery of the enzyme, for example, using RP-HPLC. In such examples, in the formulations provided herein the hyaluronidase enzyme recovery is from between or about between 60% to 140%. For example, in the formulations provided herein the hyaluronidase enzyme recovery is from between or about between 3-7 μg/mL.

2. Divalent Cation

The stable hyaluronan-degrading enzyme formulations provided herein contain an amount of a divalent cation to achieve at least 50%, and generally at least 70%, of the initial enzymatic activity of the hyaluronan-degrading enzyme at temperatures of between or approximately between 37° C. to 42° C., such as at least or about or approximately 37° C. or 40° C., for at least three (3) days and generally at least one month (e.g. 4 weeks) as described herein. For example, the amount of divalent cation is an amount to achieve at least 75%, 80%, 85%, 86%, 87%, 88%, 89%, 90%, 91%, 92%, 93%, 94%, 95%, 96%, 97%, 98%, 99% or more of the initial enzymatic activity of the hyaluronan-degrading enzyme for at least three (3) days, and generally for at least 4 weeks at temperatures between or approximately between 37° C. to 42° C., such as at least or about or approximately 40° C.

For example, stable hyaluronan-degrading formulations provided herein can contain an amount of Lys-Lys, salt, derivative, analogue or mimetic thereof, to achieve at least 50%, and generally at least 70%, of the initial enzymatic activity of the hyaluronan-degrading enzyme at temperatures between or approximately between 37° C. to 42° C., such as at least or about or approximately 40° C., for at least three (3) days and generally for at least 4 weeks. Such stable hyaluronan-degrading enzyme (e.g. a hyaluronidase for example a PH20) formulation provided herein contain between or about between 5 mM to 300 mM Lys-Lys, such as 10 mM to 200 mM, 50 mM to 150 mM or 10 mM to 50 mM. For example, stable hyaluronan-degrading enzyme (e.g. a hyaluronidase for example a PH20) formulation provided herein contains at least or about at least or 5 mM, 10 mM, 20 mM, 30 mM, 40 mM, 50 mM, 60 mM, 70 mM, 80 mM, 90 mM, 100 mM, 125 mM, 150 mM, 200 mM, 300 mM or more Lys-Lys.

In another example, stable hyaluronan-degrading formulations provided herein can contain an amount of $MgCl_2$, derivative, analogue or mimetic thereof, to achieve at least 50%, and generally at least 70%, of the initial enzymatic activity of the hyaluronan-degrading enzyme at temperatures between or approximately between 37° C. to 42° C., such as at least or about or approximately 40° C., for at least three (3) days and generally for at least 4 weeks. Such stable hyaluronan-degrading enzyme (e.g. a hyaluronidase for example a PH20) formulation provided herein contain between or about between 5 mM to 300 mM $MgCl_2$, such as 10 mM to 200 mM, 50 mM to 150 mM or 10 mM to 50 mM. For example, stable hyaluronan-degrading enzyme (e.g. a hyaluronidase for example a PH20) formulation provided herein contains at least or about at least or 5 mM, 10 mM, 20 mM, 30 mM, 40 mM, 50 mM, 60 mM, 70 mM, 80 mM, 90 mM, 100 mM, 125 mM, 150 mM, 200 mM, 300 mM or more $MgCl_2$.

As discussed below, formulations containing a divalent cation (e.g. Lys-Lys), if necessary, also can contain a tonicity modifier (e.g. NaCl).

3. pH and Buffer

Provided herein are stable formulations of a hyaluronan-degrading enzyme, such as a hyaluronidase for example a PH20 (e.g. rHuPH20) that have a pH of between or of about between 6.5 to 7.8 or 6.8 to 7.8 such as between or about between 6.5 to 7.5 or 7.0 to 7.6. Reference to pH herein is based on measurement of pH at room temperature. It is understood that the pH can change during storage over time, but typically will remain between or between about pH 6.5 to 7.8, for example between or about between 6.8 to or to about 7.8. For example, the pH can vary by ±0.1, 0.2, 0.3, 0.4, 0.5, 0.6, 0.7, 0.8, 0.9, 1.0, 1.2, 1.3, 1.4, 1.5 or more. Thus, it is understood that reference to a formulation that has a pH of about or at least pH 6.5, 6.6, 6.7, 6.8, 6.9, 7.0, 7.1, 7.2, 7.3, 7.4 or 7.6 includes co-formulations that have a pH of or of about or at least 6.5±0.2, 6.6±0.2, 6.7±0.2, 6.8±0.2, 6.9±0.2, 7.0±0.2, 7.1±0.2, 7.2±0.2, 7.3±0.2, 7.4±0.2, 7.5±0.2 or 7.6±0.2 when prepared.

If necessary, pH can be adjusted using acidifying agents to lower the pH or alkalizing agents to increase the pH. Exemplary acidifying agents include, but are not limited to, acetic acid, citric acid, sulfuric acid, hydrochloric acid, monobasic sodium phosphate solution, and phosphoric acid. Exemplary alkalizing agents include, but are not limited to, dibasic sodium phosphate solution, sodium carbonate, or sodium hydroxide.

Any buffer can be used in co-formulations provided herein so long as it does not adversely affect the stability of the formulation, and supports the requisite pH range required. Examples of particularly suitable buffers include Tris, succinate, acetate, phosphate buffers, histidine, citrate, aconitate, malate and carbonate. Those of skill in the art, however, will recognize that formulations provided herein are not limited to a particular buffer, so long as the buffer provides an acceptable degree of pH stability, or "buffer capacity" in the range indicated. Generally, a buffer has an adequate buffer capacity within about 1 pH unit of its pK (Lachman et al. 1986). Buffer suitability can be estimated based on published pK tabulations or can be determined empirically by methods well known in the art. The pH of the solution can be adjusted to the desired endpoint within the range as described above, for example, using any acceptable acid or base.

Buffers that can be included in the co-formulations provided herein include, but are not limited to, Tris (Tromethamine), histidine, phosphate buffers, such as dibasic sodium phosphate, and citrate buffers. For example, the buffer can be a histidine hydrochloride (histidine/HCl) buffer. Generally, the buffering agent is present in an amount herein to maintain the pH range of the co-formulation between or about between 6.5 to 7.8, for example between or about between 6.8 to 7.8 such as between or about between 7.0 to 7.6. Such buffering agents can be present in the formulations at concentrations between or about between 1 mM to 100 mM, such as 10 mM to 50 mM or 20 mM to 40 mM, such as at or about 30 mM. For example, such buffering agents can be present in the co-formulations in a concentration of or about or at least 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 16 mM, 17 mM, 18 mM, 19 mM, 20 mM, 25 mM, 30 mM, 35 mM, 40 mM, 45 mM, 50 mM, 55 mM, 60 mM, 65 mM, 70 mM, 75 mM, or more.

In some examples, a buffering agent is not required.

4. Surfactant

The stable formulations provided herein contain one or more surfactants. Such surfactants inhibit aggregation of the hyaluronan-degrading enzyme, such as a hyaluronidase for example a PH20 (e.g. rHuPH20) and minimize absorptive loss. The surfactants generally are non-ionic surfactants. Surfactants that can be included in the formulations herein include, but are not limited to, partial and fatty acid esters and ethers of polyhydric alcohols such as of glycerol, or sorbitol, poloxamers and polysorbates. For example, exemplary surfactants in the formulations herein include any one or more of poloxamer 188 (PLURONICS® such as PLURONIC® F68), TETRONICS®, polysorbate 20, polysorbate 80, PEG 400, PEG 3000, Tween® (e.g. Tween® 20 or Tween® 80), Triton® X-100, SPAN®, MYRJ®, BRIJ®, CREMOPHOR®, polypropylene glycols or polyethylene glycols. In some examples, the formulations herein contain poloxamer 188, polysorbate 20, polysorbate 80, generally poloxamer 188 (pluronic F68). The formulations provided herein generally contain at least one surfactant, such as 1, 2 or 3 surfactants.

In the formulations provided herein, the total amount of the one or more surfactants as a percentage (%) of mass concentration (w/v) in the formulation can be, for example, between from or between about from 0.0005% to 1.0%, such as between or about between 0.0005% to 0.005%, 0.001% to 0.01%, 0.01% to 0.5%, 0.01% to 0.1% or 0.01% to 0.02%. Generally, the formulations contain at least 0.01% surfactant and contain less than 1.0%, such as less than 0.5% or less than 0.1% surfactant. For example, the formulations provided herein can contain at or about 0.001%, 0.005%, 0.01%, 0.015%, 0.02%, 0.025%, 0.03%, 0.035%, 0.04%, 0.045%, 0.05%, 0.055%, 0.06%, 0.065%, 0.07%, 0.08%, or 0.09% surfactant. In particular examples, the formulations provided herein contain or contain about 0.01% to or to about 0.05% surfactant.

It is found herein that oxidation of the enzyme is increased with increasing levels of surfactant. Also, the surfactant poloxamer 188 causes less oxidation than the polysorbates. Hence, the formulations herein generally contain poloxamer 188. Thus, although surfactants are able to stabilize a hyaluronan-degrading enzyme, the inclusion of surfactants in the formulations provided herein can result in oxidation of the hyaluronan-degrading enzyme at high concentrations. Thus, generally lower concentrations of surfactant are used in the co-formulations herein, for example, as a percentage (%) of mass concentration (w/v) of less than 1.0% and generally between or about between 0.01% or 0.05%, such as 0.01%. Also, as provided herein below, optionally an anti-oxidation agent can be included in the formulation to reduce or prevent oxidation.

5. Anti-Oxidation Agent

The formulations provided herein also can contain antioxidants to reduce or prevent oxidation, in particular oxidation of the hyaluronan-degrading enzyme. For example, the examples herein show that oxidation can be effected by high concentrations of surfactant. Exemplary antioxidants include, but are not limited to, cysteine, tryptophan and methionine. In particular examples, the anti-oxidant is methionine. The formulations provided herein can include an antioxidant at a concentration from between or from about between 5 mM to or to about 50 mM, such as 5 mM to 40 mM, 5 mM to 20 mM or 10 mM to 20 mM. For example, methionine can be provided in the formulations herein at a concentration from between or from about between 5 mM to or to about 50 mM, such as 5 mM to 40 mM, 5 mM to 20 mM or 10 mM to 20 mM. For example, an antioxidant, for example methionine, can be included at a concentration that is or is about or is at least 5 mM, 10 mM, 11 mM, 12 mM, 13 mM, 14 mM, 15 mM, 16 mM, 17 mM, 18 mM, 19 mM, 20 mM, 21 mM, 22 mM, 23 mM, 24 mM, 25 mM, 26 mM, 27 mM, 28 mM, 29 mM, 30 mM, 35 mM, 40 mM, 45 mM or 50 mM. In some examples, the co-formulations contain 10 mM to 20 mM methionine, such as or about or at least 10 mM or 20 mM methionine.

6. Tonicity Modifier

Optionally, the stable hyaluronan-degrading enzyme formulations provided herein can contain a tonicity modifier. In particular, a tonicity modifier is necessary in formulations containing lower concentrations of a divalent cation, such as Lys-Lys, since sufficient tonicity is not achieved.

For example, a tonicity modifier is included in the formulations herein to produce a solution with the desired osmolality. The formulations provided herein have an osmolality of between or about between 245 mOsm/kg to 500 mOsm/kg. For example, the osmolality is or is about or at least 245 mOsm/kg, 250 mOsm/kg, 255 mOsm/kg, 260 mOsm/kg, 265 mOsm/kg, 270 mOsm/kg, 275 mOsm/kg, 280 mOsm/kg, 285 mOsm/kg, 290 mOsm/kg, 295 mOsm/kg, 300 mOsm/kg, 350 mOsm/kg, 400 mOsm/kg, 450 mOsm/kg or 500 mOsm/kg. Typically, a tonicity modified is included in the formulations herein that contain a divalent cation, such as Lys-Lys, in a concentration that is less than 100 mM, such as less than 80 mM, 70 mM, 60 mM, 50 mM, 40 mM, 30 mM, 20 mM, 10 mM or less. For example, a tonicity modified is included in the formulations herein that contain a divalent cation, such as Lys-Lys, at a concentration of between or about between 10 mM to 50 mM, such as about or approximately 10 mM, 15 mM, 20 mM, 25 mM, 30 mM, 35 mM, 40 mM, 45 mM or 50 mM.

Tonicity modifiers include, but are not limited to, glycerin, NaCl, amino acids, polyalcohols, trehalose, and other salts and/or sugars. For example, the formulations provided herein can optionally include NaCl as a tonicity modifier. The NaCl can be included at a concentration of between or about between 0 mM to 200 mM, such as generally 30 mM to 100 mM, 50 mM to 160 mM, for example 50 mM to 120 mM or 80 mM to 140 mM. Generally, the NaCl is less than 150 mM, and generally less than 140 mM, 130 mM, 120 mM, 110 mM, 100 mM, 90 mM, 80 mM, 70 mM, 60 mM, 50 mM, 40 mM, 30 mM, 20 mM, 10 mM or less. The particular amount is a function of the concentration of divalent cation, for example Lys-Lys. For example, the higher concentration of Lys-Lys, the lower the concentration of NaCl (or no NaCl). The particular amount can be empirically determined in order to retain enzyme activity and/or tonicity.

In another example, glycerin (glycerol) is optionally included in the stable formulations. For example, formulations provided herein typically contain less than 60 mM glycerin, such as less than 55 mM, less than 50 mM, less than 45 mM, less than 40 mM, less than 35 mM, less than 30 mM, less than 25 mM, less than 20 mM, less than 15 mM, 10 mM or less. The amount of glycerin typically depends on the amount of divalent cation (e.g. Lys-Lys) present: the more divalent cation (e.g. Lys-Lys) present in the formulation, the less glycerin is required to achieve the desired osmolarity. Thus, in some cases, little or no glycerin need be included in the formulation.

7. Other Agents or Excipients

The stable formulations provided herein can optionally contain one or more other agents, carriers, excipients or preservatives. For example, exemplary stabilizers that optionally can be included in the stable hyaluronan-degrading enzyme formulations provided herein include, but are not limited to, amino acids, amino acid derivatives, amines, sugars, polyols, salts and buffers, surfactants, and other agents. For example, included among the types of stabilizers that optionally can be contained in the formulations herein is an amino acid stabilizer or a hyaluronidase inhibitor (e.g. a hyaluronidase substrate, such as hyaluronan). Exemplary amino acid stabilizers, amino acid derivatives or amines include, but are not limited to, L-Arginine, Glutamine, glycine, Lysine, Methionine, Proline, Lys-Lys, Gly-Gly, Trimethylamine oxide (TMAO) or betaine. Exemplary of sugars and polyols include, but are not limited to, glycerol, sorbitol, mannitol, inositol, sucrose or trehalose. Exemplary of salts and buffers include, but are not limited to, magnesium chloride, sodium sulfate, Tris such as Tris (100 mM), or sodium Benzoate. Exemplary surfactants include, but are not limited to, poloxamer 188 (e.g. Pluronic® F68), polysorbate 80 (PS80), polysorbate 20 (PS20). Other stabilizers include, but are not limited to, hyaluronic acid (HA), human serum albumin (HSA), phenyl butyric acid, taurocholic acid, polyvinylpyrolidone (PVP) or zinc. In particular examples herein, the stable hyaluronan-degrading enzymes do not contain HSA and are HSA-free formulations.

For stable formulations formulated for multiple dose administration, the formulations also can optionally contain an amount of preservative(s) that, when combined with the components set forth above, result in a stable formulation. When included, the preservatives are present in a sufficient concentration to provide the anti-microbial requirements of, for example, the United States Pharmacopoeia (USP) and the European Pharmacopoeia (EP). Table 23, in Example 7E below, sets forth these requirements, including the minimum EP anti-microbial requirements (EPA) and the preferred EP anti-microbial requirements (EPB). Typically, formulations that meet EP (EPA or EPB) anti-microbial requirements contain more preservative than those formulated only to meet USP anti-microbial requirements. Generally, when included, the formulations provided herein contain preservative(s) in an amount that exhibits anti-microbial activity by killing or inhibiting the propagation of microbial organisms in a sample of the composition as assessed in an antimicrobial preservative effectiveness test (APET) as discussed elsewhere herein. Non-limiting examples of preservatives that can be included in the formulations provided herein include, but are not limited to, phenol, meta-cresol (m-cresol), methylparaben, benzyl alcohol, thimerosal, benzalkonium chloride, 4-chloro-1-butanol, chlorhexidine dihydrochloride, chlorhexidine digluconate, L-phenylalanine, EDTA, bronopol (2-bromo-2-nitropropane-1,3-diol), phenylmercuric acetate, glycerol (glycerin), imidurea, chlorhexidine, sodium dehydroacetate, ortho-cresol (o-cresol), para-cresol (p-cresol), chlorocresol, cetrimide, benzethonium chloride, ethylparaben, propylparaben or butylparaben and any combination thereof. In one example, the preservative in the formulation contains at least one phenolic preservative. For example, the formulation contains phenol, m-cresol or phenol and m-cresol. When included in the formulations provided herein, the total amount of the one or more preservative agents as a percentage (%) of mass concentration (w/v) in the formulation can be, for example, between from or between about from 0.1% to 0.4%, such as 0.1% to 0.3%, 0.15% to 0.325%, 0.15% to 0.25%, 0.1% to 0.2%, 0.2% to 0.3%, or 0.3% to 0.4%, and generally less than 0.4% (w/v) preservative, for example, at least or about at least 0.1%, 0.12%, 0.125%, 0.13%, 0.14%, 0.15%, 0.16%, 0.17%, 0.175%, 0.18%, 0.19%, 0.2%, 0.25%, 0.3%, 0.325%, 0.35% but less than 0.4% total preservative.

Optionally, the formulations can include carriers such as a diluent, adjuvant, excipient, or vehicle with which the formulation is administered. Examples of suitable pharmaceutical carriers are described in "Remington's Pharmaceutical Sciences" by E. W. Martin. Such compositions will contain a therapeutically effective amount of the compound, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions.

For example, pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidone, celluloses and derivatives thereof, povidone, crospovidones and other such binders known to those of skill in the art.

For example, an excipient protein can be added to the formulation that can be any of a number of pharmaceutically acceptable proteins or peptides. Generally, the excipient protein is selected for its ability to be administered to a mammalian subject without provoking an immune response. For example, human serum albumin is generally well-suited for use in pharmaceutical formulations, although it typically is not included in the stable formulations herein. Other known pharmaceutical protein excipients include, but are not limited to, starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. The excipient is included in the formulation at a sufficient concentration to prevent adsorption of the protein to the holding vessel or vial. The concentration of the excipient will vary according to the nature of the excipient and the concentration of the protein in the co-formulation.

A composition, if desired, also can contain minor amounts of wetting or emulsifying agents, or pH buffering agents, for example, acetate, sodium citrate, cyclodextrin derivatives, sorbitan monolaurate, triethanolamine sodium acetate, triethanolamine oleate, and other such agents.

8. Exemplary Stable Hyaluronan-Degrading Enzyme Formulations

Provided herein are stable hyaluronan-degrading enzyme formulations that are stable at temperatures of 37° C. to 42° C., such as greater than or equal to 37° C. or 40° C., for at least three (3) days, and generally at least one month that contain.

In one example, an exemplary formulation contains: 100 U/mL to 1000 U/mL, such as 100 U/mL to 500 U/mL or 100 U/mL to 300 U/mL of a hyaluronan-degrading enzyme such as a hyaluronidase for example a PH20 (e.g. rHuPH20), and in particular at least or about at least or about 155 U/mL of a hyaluronan-degrading enzyme such as a hyaluronidase for example a PH20 (e.g. rHuPH20); from or from about 5 mM to or to about 200 mM, such as 10 mM to 50 mM or 5 mM to 20 mM Lys-Lys (e.g. at least or about at least 10 mM, 20 mM, 30 mM, 40 mM or 50 mM); from or from about 0 mM to or to about 300 mM dibasic sodium phosphate (e.g. from or from about 0 mM to 150 mM or 5 mM to 50 mM dibasic sodium phosphate, such as at least or about at least 5 mM, 10 mM, 20 mM, 30 mM, 40 mM or 50 mM, 100 mM or 150 mM); 0 mM to or to about 50 mM methionine (e.g. between or about between 5 mM to 20 mM, such as at least or about at least 5 mM, 10 mM, 20 mM, 30 mM, 40 mM or 50 mM methionine); and from or from about 0.01% to or to about 0.5% poloxamer 188, such as 0.01% to 0.05% (e.g. at least or about at least 0.01%, 0.02%, 0.03%, 0.04% or 0.05% polysorbate 80). The formulations are prepared with a pH from or from about 6.5 to 7.6, such as from or from about 6.5 to 7.2 or 7.0 to or to about 7.6 (e.g. at least or about at least pH 6.5, 6.6, 6.7, 6.8, 6.9, 7.0, 7.1, 7.2, 7.3, 7.4, 7.5 or 7.6). In further examples, NaCl is included at a concentration less than 140 mM. For example, NaCl is included in a concentration of or about 50 mM to 150 mM, such as at least or about at least 50 mM, 60 mM, 70 mM, 80 mM, 90 mM or 100 mM.

In another example, an exemplary formulation contains: 100 U/mL to 1000 U/mL, such as 100 U/mL to 500 U/mL or 100 U/mL to 300 U/mL of a hyaluronan-degrading enzyme such as a hyaluronidase for example a PH20 (e.g. rHuPH20), and in particular at least or about at least or about 155 U/mL of a hyaluronan-degrading enzyme such as a hyaluronidase for example a PH20 (e.g. rHuPH20); from or from about 5 mM to or to about 200 mM, such as between or about between 50 mM to 150 mM MgCl$_2$ (e.g. at least or about at least 50 mM, 60 mM, 70 mM, 80 mM, 90 mM, 100 mM, 110 mM, 120 mM, 130 mM or 150 mM); from or from about 0 mM to or to about 300 mM histidine hydrochloride (e.g. from or from about 0 mM to 150 mM or 5 mM to 50 mM histidine hydrochloride, such as at least or about at least 5 mM, 10 mM, 20 mM, 30 mM, 40 mM or 50 mM, 100 mM or 150 mM); from or from about 0 mM to or to about 50 mM methionine (e.g. between or about between 5 mM to 20 mM, such as at least or about at least 5 mM, 10 mM, 20 mM, 30 mM, 40 mM or 50 mM methionine); and from or from about 0.01% to or to about 0.5% poloxamer 188, such as 0.01% to 0.05% (e.g. at least or about at least 0.01%, 0.02%, 0.03%, 0.04% or 0.05% polysorbate 80). The formulations are prepared with a pH from or from about 6.5 to 7.6, such as from or from about 6.5 to 7.2 or 7.0 to or to about 7.6 (e.g. at least or about at least pH 6.5, 6.6, 6.7, 6.8, 6.9, 7.0, 7.1, 7.2, 7.3, 7.4, 7.5 or 7.6).

E. INSULIN POLYPEPTIDES

Provided herein are co-formulations of a hyaluronan-degrading enzyme and an insulin. The co-formulations provided herein contain a fast-acting insulin, such as a regular insulin or an insulin analog (e.g. called a fast-acting analog or a rapid-acting analog, used interchangeably herein) that is modified (e.g. by amino acid replacement) to reduce self-association of insulin and result in more rapid dissociation of hexamers.

Insulin is a polypeptide composed of 51 amino acid residues that is 5808 daltons in molecular weight. It is produced in the beta-cell islets of Langerhans in the pancreas. An exemplary human insulin is translated as a 110 amino acid precursor polypeptide, preproinsulin (SEQ ID NO:101), containing a 24 amino acid signal peptide to ER, the signal sequence is cleaved, resulting in proinsulin (SEQ ID NO:102). The proinsulin molecule is subsequently converted into a mature insulin by actions of proteolytic enzymes, known as prohormone convertases (PC1 and PC2) and by actions of the exoprotease carboxypeptidase E. This results in removal of 4 basic amino acid residues and the remaining 31 amino acid C-peptide or connecting chain (corresponding to amino acid residues 57 to 87 of the preproinsulin polypeptide set forth in SEQ ID NO:101) The resulting insulin contains a 21 amino acid A-chain (corresponding to amino acid residues 66 to 86 of the proinsulin polypeptide set forth in SEQ ID NO:102) and a 30 amino acid B-chain (corresponding to amino acid residues 1 to 30 of the proinsulin polypeptide set forth in SEQ ID NO:102), which are cross-linked by disulfide bonds. Typically, mature insulin contains three disulfide bridges: one between position 7 of the A-chain and position 7 of the B-chain, a second between position 20 of the A-chain and position 19 of the B-chain, and a third between positions 6 and 11 of the A-chain. The sequence of the A chain of a mature insulin is set forth in SEQ ID NO:103 and the sequence of the B-chain is set forth in SEQ ID NO:104.

Reference to insulin includes preproinsulin, proinsulin and insulin polypeptides in single-chain or two-chain forms, truncated forms thereof that have activity, and includes allelic and species variants, variants encoded by splice variants and other variants, such as insulin analogs or other derivatized forms, including polypeptides that have at least 40%, 45%, 50%, 55%, 60%, 65%, 70%, 75%, 80%, 85%, 90%, 95%, 96%, 97%, 98%, 99% or more sequence identity to the precursor polypeptide set forth in SEQ ID NO:101 or the mature form thereof, so long as the insulin binds to the human insulin receptor to initiate a signaling cascade that results in an increase of glucose uptake and storage and/or a decrease of endogenous glucose production. For example, insulins include species variants of insulin. These include, but are not limited to, insulins derived from bovine (set forth in SEQ ID NO:133) and porcine (SEQ ID NO:123). Bovine insulin differs from human insulin at amino acids 8 and 10 of the A chain, and amino acid 30 of the B chain. Porcine insulin only differs from human insulin at amino acid 30 in the B chain where, like the bovine sequence, there is an alanine substitution in place of threonine. Other exemplary species variants of insulin are set forth in any of SEQ ID NOS: 105-146.

Also included among variants of insulin are insulin analogs that contain one or more amino acid modifications compared to a human insulin set forth in SEQ ID NO: 103 and 104 (A and B chains). These variants include fast-acting or longer-acting insulin analogs (all designated herein as a fast-acting insulin analog, although it is understood that for purposes herein this includes rapid-acting and longer-acting insulin analog forms). Exemplary insulin analogs (A and B chains), including fast-acting and longer-acting analog forms, are set forth in SEQ ID NOS:147-165, 182-184). For example, insulin analogs include, but are not limited to, glulisine (LysB3, GluB29; set forth in SEQ ID NO:103 (A-chain) and SEQ ID NO:149 (B-chain)), HMR-1 153 (LysB3, IleB28; set forth in SEQ ID NO:103 (A-chain) and SEQ ID NO:182 (B-chain)), HMR-1423 (GlyA21, HisB31, HisB32; set forth in SEQ ID NO:183 (A-chain) and SEQ ID NO:184 (B-chain)), insulin aspart (AspB28; set forth in SEQ ID NO:103 (A-chain) and SEQ ID NO:147 (B-chain)), and insulin lispro (LysB28, ProB29; set forth in SEQ ID NO:103 (A-chain) and SEQ ID NO:148 (B-chain)). In every instance above, the nomenclature of the analogs is based on a description of the amino acid substitution at specific positions on the A or B chain of insulin, numbered from the N-terminus of the chain, in which the remainder of the sequence is that of natural human insulin.

Hence, regular insulin as provided in co-formulations herein is a mature insulin that contains a sequence of amino acids set forth in SEQ ID NOS: 103 and 104. Exemplary of a regular human insulin is recombinant human insulin designated Humulin® R. Regular insulins also includes species variants of mature insulin having an A and B chain, for example, mature forms of any of SEQ ID NOS: 105-146. Other exemplary insulin analogs included in the co-formulations herein include, but are not limited to an insulin that has a sequence of amino acids set forth in SEQ ID NO:103 (A-chain) and SEQ ID NO:149 (B-chain); a sequence of amino acids set forth in SEQ ID NO:103 (A-chain) and SEQ ID NO:147 (B-chain); or a sequence of amino acids set forth in SEQ ID NO:103 (A-chain) and SEQ ID NO:148 (B-chain).

Any of the above insulin polypeptides include those that are produced by the pancreas from any species, such as a human, and also include insulins that are produced synthetically or using recombinant techniques. For example, as described elsewhere herein, insulin can be produced biosynthetically by expressing synthetic genes for A and B chains of insulin, by expressing the entire proinsulin and exposing it to the appropriate enzymatic and chemical methods to generate a mature insulin, or by expressing A and B chains connected by a linker peptide (see e.g., DeFelippis et al. (2002) *Insulin Chemistry and Pharmacokinetics*. In Ellenberg and Rifkin's Diabetes Mellitus (pp. 481-500) McGraw-Hill Professional).

Insulins also include monomeric and oligomeric forms, such as hexameric forms. Insulin can exist as a monomer as it circulates in the plasma, and it also binds to its receptor while in a monomeric form. Insulin, however, has a propensity to self-associate into dimers, and in the presence of metal ions such as $Zn^{2+}$ can readily associate into higher order structures such as hexamers. There are two symmetrical high affinity binding sites for $Zn^{2+}$, although other weaker zinc-binding sites also have been reported (see e.g., DeFelippis et al. (2002) *Insulin Chemistry and Pharmacokinetics*. In Ellenberg and Rifkin's Diabetes Mellitus (pp. 481-500) McGraw-Hill Professional). Self-association is important for the stability of the molecule to prevent chemical degradation and physical denaturation. Thus, in storage vesicles in pancreatic beta-cells, insulin exists as a hexamer. Upon release into the extracellular space, however, it is believed that the insulin hexamers can experience a change in pH to more neutral conditions and the zinc ion-containing hexamers are diluted, which destabilizes the hexamer. There may be other reasons contributing to the destabilization of the insulin hexamer in the extracellular space. Insulin is thus predominantly found in the blood as a monomer. To take advantage of the stabilizing effects, most commercial formulations of insulin contain zinc ions in sufficient amounts to promote self-association into hexamers. The hexameric structure, however, slows down the absorption rate of these formulations upon subcutaneous administration.

Insulin is used as a therapeutic for glycemic control, such as in diabetic patients. There are various types of insulin formulations that exist, depending on whether the insulin is being administered to control glucose for basal therapy, for prandial therapy, or for a combination thereof. Insulin formulations can be provided solely as fast-acting formulations, solely as basal-acting formulations (i.e., intermediate-acting and/or long-acting forms), or as mixtures thereof (see e.g., Table 4). Typically, mixtures contain a fast-acting and an intermediate- or long-acting insulin. For example, fast-acting insulins can be combined with an NPH insulin (an exemplary intermediate-acting insulin as discussed below) in various mixture ratios including 10:90, 20:80, 30:70, 40:60, and 50:50. Such premixed preparations can reduce the number of daily insulin injections by conveniently providing both meal-related and basal insulin requirements in a single formulation.

Preparations of insulin include an insulin polypeptide or variant (i.e. analog) thereof formulated in a specific manner. In some instances, it is the components and substances in the formulation that impart different properties on the insulin, such as different duration of action. For example, most insulin preparations contain a metal ion, such as zinc, in the formulation, which stabilizes the insulin by promoting self-association of the molecule. Self-association into hexameric forms can affect the absorption of insulin upon administration. Further, some longer-acting basal insulin formulations are prepared by precipitating insulin from an acetate buffer (instead of phosphate) by the addition of zinc. Large crystals of insulin with high zinc content, when collected and resuspended in a solution of sodium acetate-sodium chloride (pH 7.2 to 7.5), are slowly absorbed after subcutaneous injection and exert an action of long duration. This crystal preparation is named extended insulin zinc suspension (ultralente insulin). Other zinc-containing insulin preparations include, for example, semilente insulins (prompt insulin zinc suspensions) and Lente insulins (insulin zinc suspensions), which differ predominantly in the zinc concentration used. Zinc-containing insulin preparations also include those that are modified by protamine, such as NPH insulin.

In another example, a precipitation agent, such as protamine, can be added to an insulin polypeptide to generate a microcrystalline suspension. Typically, crystalline insulins have a prolonged duration of action compared to insulins that do not exist in crystalline form. A protamine zinc insulin, when injected subcutaneously in an aqueous suspension, dissolves only slowly at the site of deposition, and the insulin is absorbed at a retarded rate. Protamine zinc suspension insulin has largely been replaced by isophane insulin suspension, also known as NPH insulin. It is a modified protamine zinc insulin suspension that is crystalline. The concentrations of insulin, protamine, and zinc are so arranged that the preparation has an onset and a duration of action intermediate between those of regular insulin and protamine zinc insulin suspension.

Further, pH differences in the preparations also influence the type and property of insulin. Most insulins are formulated at neutral pH. One exception is insulin glargine, which is provided as a commercial formulation at pH 4.0. By virtue of the addition of two arginines to the C-terminus of the B-chain, the isoelectric point of the glargine insulin is shifted making it more soluble at an acidic pH. An additional amino acid change exists in the A chain (N21G) to prevent deamidation and dimerization resulting from an acid-sensitive asparagine. The sequence of the A chain of glargine insulin is set forth in SEQ ID NO:150 and the B-chain is set forth in SEQ ID NO:151. Since exposure to physiologic pH occurs upon administration, microprecipitates are formed, which make glargine similar to a crystalline, long-acting insulin.

Table 4 below summarizes various types of insulin, their onset of action and their application.

TABLE 4

Types of Insulins

| Type | Brand name | Onset | Peak | Duration | Application |
|---|---|---|---|---|---|
| Fast-acting: Insulin analogs | Lispro (e.g. Humalog ®); Aspart (e.g., NovoLog ®); Glulisine | 5-15 minutes | 45-90 minutes | 3-4 hours | Post-prandial glucose control |
| Fast-acting: Regular insulin | Regular Insulin (e.g., Humulin ® R; Novolin ® R; Velosulin ® Human) | 30 minutes-1 hour | 2-5 hours | 5-8 hours | Post-prandial glucose control |
| Intermediate-Acting | Lente ® (e.g., Humulin ® L, Novolin ® L); NPH (e.g., Humulin ® N, Novolin ® N); | 1-3 hours | 6-12 hours | 20-24 hours | Basal insulin supplementation |
| Long-lasting | Ultralente (e.g. Humulin ® U); glargine; detemir (an analog) | 4-6 hours | 18-28 hours | 28 hours | Basal insulin supplementation |
| Mixtures | Humulin ® 50/50; Humulin ® 70/30; Novolin ® 70/30; Humalog ® Mix 75/25 | Varies | Varies | Varies | |

The most commonly used insulins are fast-acting insulins, which include regular insulin (i.e. native or wildtype insulin, including allelic and species variants thereof) and fast-acting insulin analogs. For purposes herein, reference to insulin is a fast-acting insulin, unless specifically noted otherwise.

Fast-Acting Insulins

Fact-acting insulins that can be used in the co-formulations provided herein of insulin and a hyaluronan degrading enzyme, such as a hyaluronidase for example a PH20 (e.g. rHuPH20), include regular insulin, which is the wild-type or native insulin, and fast-acting insulin analogs. By virtue of their fast absorption rate compared to basal-acting insulins, fast-acting insulins are used predominantly for post-prandial control purposes. Exemplary fast-acting insulins are set forth in Table 5 below. Fast-acting insulins also include any known in the art, such as, but not limited to, any insulin preparations and devices disclosed in U.S. Pat. No. 7,279, 457 and U.S. Pat. Pub. Nos. 20070235365, 20080039368, 20080039365, 20070086952, 20070244467, and 20070191757. Any fast-acting insulin can be combined in co-formulations with a hyaluronan degrading enzyme provided herein. Such a formulation also can further include a mixture of a fast-acting insulin with an intermediate or long-acting insulin, in addition to a hyaluronan degrading enzyme.

TABLE 5

Fast Acting Insulins

| Name | Species | A-chain (SEQ ID NO) | B-chain (SEQ ID NO) | Commercial Name |
|---|---|---|---|---|
| Regular Insulin | Human | 103 | 104 | Humulin R ®; Novolin ® R; Velosulin ® |
| Regular Insulin | Porcine | 88-108 of SEQ ID NO: 123 | 25-54 of SEQ ID NO: 123 | Iletin II ®; |
| Insulin Aspart | Human analog | 103 | 147 | Novolog ® |
| Insulin Lispro | Human analog | 103 | 148 | Humalog ® |
| Insulin Glulisine | Human analog | 103 | 149 | Apidra ® | a. Regular Insulin

Regular insulins include the native or wildtype insulin polypeptide. These include human insulin, as well as insulins from bovine, porcine and other species. Regular human insulins are marketed as Humulin® R, Novolin® R and Velosulin®. Porcine insulin was marketed as Iletin II®. Generally, regular insulin, when administered subcutaneously alone, has an onset of action of 30 minutes. Maximal plasma levels are seen in 1-3 hours and the duration of intensity increases with dosage. The plasma half-life following subcutaneous administration is about 1.5 hours.

b. Fast-Acting Analogs (Also Called Rapid-Acting Insulins)

Fast-Acting insulin analogs, which are often called rapid-acting insulins in the art, are modified forms of insulin that typically contain one or more amino acid changes. The analogs are designed to reduce the self-association of the insulin molecule for the purpose of increasing the absorption rate and onset of action as compared to regular insulin. Generally, such analogs are formulated in the presence of zinc, and thus exist as stable zinc hexamers. Due to the modification, however, they have a quicker dissociation from the hexameric state after subcutaneous administration compared to regular insulin.

i. Insulin Lispro

Human insulin lispro is an insulin polypeptide formulation containing amino acid changes at position 28 and 29 of the B-chain such that the Pro-Lys at this position in wild-type insulin B-chain set forth in SEQ ID NO:104 is inverted to Lys-Pro. The sequence of insulin lispro is set forth in SEQ ID NO:103 (A-chain) and SEQ ID NO: 148 (B-chain). It is marketed under the name Humalog® (insulin lispro, rDNA origin). The result of the inversion of these two amino acids is a polypeptide with a decreased propensity to self-associate, which allows for a more rapid onset of action. Specifically, the sequence inversion in the B-chain results in the elimination of two hydrophobic interactions and weakening of two beta-pleated sheet hydrogen bonds that stabilize the dimer (see e.g., DeFelippis et al. (2002) *Insulin Chemistry and Pharmacokinetics*. In Ellenberg and Rifkin's Diabetes Mellitus (pp. 481-500) McGraw-Hill Professional). The polypeptide self-associates and forms hexamers as a result of excipients provided in the formulation, such as antimicrobial agents (e.g. m-cresol) and zinc for stabilization. Nevertheless, due to the amino acid modification, insulin lispro is more rapidly acting then regular insulin.

ii. Insulin Aspart

Human insulin aspart is an insulin polypeptide formulation containing an amino acid substitution at position 28 of the B-chain of human insulin set forth in SEQ ID NO:104 from a proline to an aspartic acid. The sequence of insulin aspart is set forth in SEQ ID NO:103 (A-chain) and SEQ ID NO:147 (B-chain). It is marketed under the name Novolog® (insulin aspart [rDNA origin] injection). The modification in insulin aspart confers a negatively-charged side-chain carboxyl group to create charge repulsion and destabilize the monomer-monomer interaction. Further, the removal of the proline eliminates a key hydrophobic interaction between monomers (see e.g., DeFelippis et al. (2002) *Insulin Chemistry and Pharmacokinetics*. In Ellenberg and Rifkin's Diabetes Mellitus (pp. 481-500) McGraw-Hill Professional). The analog exists largely as a monomer, and is less prone to aggregate compared to other fast-acting analogs such as lispro. Generally, insulin aspart and insulin lispro are similar in their respective pharmacokinetic and phamacodynamic properties.

iii. Insulin Glulisine

Human insulin glulisine is an insulin polypeptide formulation containing an amino acid substitution in the B-chain at position B3 from asparagine to lysine and at amino acid B29 from lysine to glutamic acid compared to the sequence of the B-chain of human insulin set forth in SEQ ID NO:104. The sequence of insulin glulisine is set forth in SEQ ID NO:103 (A-chain) and SEQ ID NO:149 (B-chain). It is marketed under the name Apidra® (insulin glulisine [rDNA origin] injection). The modifications render the polypeptide molecule less prone to self-association compared to human insulin. Unlike other insulin analogs, the polypeptide is commercially formulated in the absence of the hexamer-promoting zinc (Becker et al. (2008) *Clinical Pharmacokinetics*, 47:7-20). Hence, insulin glulisine has a more rapid rate of onset than insulin lispro and insulin aspart.

F. STABLE CO-FORMULATIONS OF INSULIN AND HYALURONAN-DEGRADING ENZYME

Provided herein are stable co-formulations of insulin, in particular fast-acting insulins including regular insulin and rapid acting insulin analogs (also called fast-acting insulin analogs), and hyaluronan degrading enzymes, such as soluble hyaluronidases (e.g. rHuPH20). Exemplary of the formulations provided herein are stable co-formulations of a rapid acting insulin analog and a PH20 or C-terminally truncated fragment thereof that is soluble and active (e.g. rHuPH20). The provided compositions containing a hyaluronan degrading enzyme and a fast-acting insulin are formulated for stability at various temperatures or under various conditions. The co-formulations provided herein are stable at from or about from 0° C. to 40° C. or under various stress conditions (e.g. agitation) for several hours, days, weeks, months or years as described herein. Hence, the formulations are suitable for multi-dose use or are suitable for other use conditions that require elevated temperatures or agitation. For example, the co-formulations are suitable for multi-dose injectable (MDI) formulations as well as continuous subcutaneous infusion (CSI) formulations. The co-formulations provided herein are formulated for administration by subcutaneous, intraperitoneal, intradermal, intramuscular, injection and transdermal routes. Exemplary formulations are formulated for subcutaneous administration.

The stable co-formulations provided herein are multi-dose formulations. Hence, all formulations provided herein contain an insulin (e.g. a fast-acting insulin such as a rapid acting insulin analog), a hyaluronan-degrading enzyme (e.g. a PH20), a preservative, and one or more other stabilizing excipients.

As described herein and exemplified in the Examples, it is found that due to the opposing requirements for stability of a hyaluronan-degrading enzymes, such as a hyaluronidase for example a PH20 (e.g. rHuPH20), and a fast-acting insulin, co-formulations cannot simply be achieved by mixing formulations of the two. For example, correct NaCl concentrations and pH are critical to the stability of co-formulations of insulin and hyaluronan-degrading enzyme (e.g. rHuPH20 or other soluble hyaluronidases and hyaluronan degrading enzymes). Determining the optimal NaCl concentration and pH is complicated by the opposite effect these parameters have on insulin and the exemplary hyaluronan-degrading enzyme rHuPH20. Insulin solubility is maximal at higher pH and lower NaCl concentration. These conditions, however, are detrimental to rHuPH20, which loses stability at higher pH and lower NaCl concentration. The stability of the exemplary hyaluronan-degrading enzyme rHuPH20 can be increased by increasing NaCl concentrations and lowering pH. However, such conditions have a negative effect of the solubility of insulin and insulin analogs, which precipitate at low pH and high NaCl concentration. Thus, among the objects herein is the provision of optimal NaCl concentrations and pH for stable formulations of insulin and rHuPH20 (or other soluble hyaluronidases and hyaluronan degrading enzymes) or provision of stable co-formulations that contain no NaCl or lower NaCl concentrations.

As described herein, the different stable formulations can be used for multiple drug injection (MDI) or can be used for continuous subcutaneous insulin infusion (CSII). The two modes of administration have differing requirements for stability. In particular, co-formulations for CSII need to be stable under accelerated (or stress) conditions, such as elevated temperatures and under agitation, while co-formulations for MDI, which can be stored at refrigerated or ambient temperatures until use, do not need to be stable at elevated temperatures and under agitation. Thus, as described elsewhere herein, the excipients or concentrations of excipients that promote stability under each of these storage conditions are not necessarily the same. For example, further excipients or stabilizers or differing concentrations of excipients or stabilizers are required to maintain stability at or at about 32-40° C. or under agitation than is required to maintain stability of the hyaluronan-degrading enzyme and/or insulin at or at about 20-30° C. or at or at about 2-8° C. These same stabilizers may not be compatible with stability of the formulations at the lower temperatures.

For example, it is found herein that while insulin is generally not stable under high NaCl concentrations and low pH conditions when stored or used at low temperatures less than 32° C., such conditions are conducive to insulin solubility at higher temperatures of 32° C. to 40° C. for at least 3 days. Thus, conditions of high NaCl and low pH can be present in co-formulations for use during CSII, which is an administration therapy that requires stability at higher temperatures. It is shown herein that formulations containing low pH (e.g. pH 6.8) and high NaCl (e.g. 200 mM) are stable at elevated temperatures, and thus suitable for CSII for at least 3 days at 37° C. Low pH (e.g. pH 6.8) and high NaCl (e.g. 200 mM) are not suitable for stability under lower storage temperatures, such as under refrigeration or ambient temperatures.

Also, the stabilizer hyaluronan (HA) is an efficient stabilizer and maintains stability of the hyaluronan-degrading enzyme at elevated temperatures for use in CSII without exhibiting any detrimental effect on insulin solubility. In this case, while hyaluronan promotes stability of the hyaluronan degrading enzyme at elevated temperature, the solubility of the insulin at refrigerated temperatures is reduced. Thus, the presence of HA in an MDI formulation for longer term storage at lower temperatures can impact insulin solubility.

It also is found herein that Lys-Lys is a particularly good stabilizer of a hyaluronan-degrading enzyme, in particular at elevated temperatures greater than 37° C. Unlike $MgCl_2$, which also is a particularly strong stabilizer of hyaluronan-degrading enzyme at elevated temperatures, Lys-Lys can be made to be compatible with insulins while maintaining solubility. For example, lower concentrations of Lys-Lys and the presence of one or more other stabilizers retains hyaluronan-degrading enzyme activity and insulin solubility under accelerated conditions such as elevated temperatures. Therefore, such Lys-Lys containing co-formulations also can be suitable for CSII applications.

Although the excipients or concentrations of excipients for a stable MDI or CSII formulation are not necessarily the same, the MDI formulations provided herein can be used to generate stable CSII formulations. Thus, in some examples, the MDI co-formulations, which are stable at refrigerated and ambient temperatures but not necessarily elevated temperatures and under stress, are diluted with a diluent that has a lower pH and higher salt concentration. This produces a formulation with a lower pH and higher salt concentration compared to the MDI formulation, and which is therefore stable at elevated temperatures and stress conditions (e.g. under agitation) and suitable for CSII. Typically, such CSII co-formulations are not stored at refrigerated temperatures due to the insolubility of insulin in compositions with low pH and high salt concentration.

Typically, the compounds are formulated into pharmaceutical compositions using techniques and procedures well known in the art (see e.g., Ansel *Introduction to Pharmaceutical Dosage Forms*, Fourth Edition, 1985, 126). Pharmaceutically acceptable compositions are prepared in view of approvals for a regulatory agency or other agency prepared in accordance with generally recognized pharmacopeia for use in animals and in humans. The formulation should suit the mode of administration.

The co-formulations can be provided as a pharmaceutical preparation in liquid form as solutions, syrups or suspensions. In liquid form, the pharmaceutical preparations can be provided as a concentrated preparation to be diluted to a therapeutically effective concentration before use. Generally, the preparations are provided in a dosage form that does not require dilution for use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

The volume of the co-formulations provided herein can be any volume suitable for the container in which it is provided. In some examples, the co-formulations are provided in a vial, syringe, pen, reservoir for a pump or a closed loop system, or any other suitable container. For example, the co-formulations provided herein are between or about between 0.1 mL to 500 mL, such as 0.1 mL to 100 mL, 1 mL to 100 mL, 0.1 mL to 50 mL, such as at least or about at least or about or 0.1 mL, 1 mL, 2 mL, 3 mL, 4 mL, 5 mL, 10 mL, 15 mL, 20 mL, 30 mL, 40 mL, 50 mL or more.

As described herein below, in some examples, the co-formulations are prepared as concentrated formulations of insulin and hyaluronan degrading enzymes, which are subsequently diluted with an appropriate diluent for use. In such instances, the concentrated co-formulations can be specifically formulated for long term storage at, for example, from or from about 2° C. to or to about 8° C. Upon dilution, the co-formulation can be used directly for MDI applications. On the other hand, since the requirements for multi-dose formulations used in MDI or for CSII therapy can be different, the components of the diluent can be chosen to ensure stability of the diluted co-formulation for applications of the co-formulation at elevated temperatures or under agitation. For example, as discussed above and further below, the diluent can contain, for example, a requisite amount or level of components or stabilizing agents that is compatible with stability of the co-formulation at elevated temperatures or under stress conditions (e.g. agitation), which are characteristic conditions of CSII therapy. Thus, when the concentrated co-formulation of insulin and hyaluronan-degrading enzyme is diluted with the diluent, the new diluted co-formulation is stable at, for example, elevated temperatures such as at least or about at least 32° C. to 40° C., such as about or 37° C. or other stress conditions (e.g. agitation), for example, for use in CSII therapy.

Provided below is a description of the components that are provided in the stable co-formulations herein. The particular balance of requirements to maximize stability of both proteins as contained in the co-formulations provided herein now renders administration with a multi-dose injectable formulation and with a CSII system (e.g. closed-pump administration) of the co-formulation achievable. A description of each of the components or conditions, such as excipients, stabilizers or pH, is provided below.

1. Components of Stable Co-Formulations

Provided herein are stable co-formulations that contain a therapeutically effective amount of a hyaluronan-degrading enzyme, such as a hyaluronidase for example a PH20 (e.g. rHuPH20). The co-formulations also contain a therapeutically effective amount of a fast-acting insulin, such as a rapid-acting (e.g. fast-acting) insulin analog. In examples of co-formulations provided herein, the co-formulations further contain NaCl at a concentration of between or about between 50 mM to 200 mM, such as 80-140 mM, a pH of between or about between 6.5 to 8.0, for example, 6.5 to 7.8 or 6.8 to 7.8 such as between or about between 6.5 to 7.5 or 7.0 to 7.6, a buffering agent that maintains the pH range, an anti-microbially effective amount of a preservative or mixture of preservatives, and a stabilizing agent in an amount that, over the course of storage (temperature and time), retains at least 50% of the hyaluronan-degrading enzyme activity and retains at least 90% of the insulin purity, recovery and/or potency. For example, the co-formulations provided herein contain 0.01% to 0.5% surfactant as a stabilizing agent. The co-formulations can optionally contain additional stabilizing agents or an anti-oxidation agent. In some examples herein, the co-formulations is stable for at least 6 months at a temperature of from or from about 2° C. to or to about 8° C. and at least 14 days (i.e. 2 weeks) at a temperature of from or about 20° C. to or to about 30° C. Such co-formulations can be used for multi-dose injection (MDI) use. In other examples, the co-formulations provided herein are stable under accelerated conditions such as elevated temperatures greater than or about greater than 32° C. such as 35° C. to 40° C., in particular greater than at or about or 37° C. or 40° C. and/or agitation conditions for at least 3 hours, and generally at least 3 days. Such co-formulations can be used for continuous subcutaneous insulin infusion (CSII) methods.

Also provided herein are co-formulations that do not contain NaCl or contain a lesser amount of NaCl, such as less than 140 mM NaCl, and generally 0 mM to 100 mM NaCl, for example, 0 mM to 50 mM, 10 mM to 40 mM, 20 mM to 30 mM, such as at least or about at least or 30 mM NaCl. In such examples, it is found herein that Lys-Lys can be included in an amount to stabilize the hyaluronan-degrading enzyme and insulin, even in the absence of NaCl. Optionally, NaCl can be included in such formulations, for example, as a tonicity modifier. This can be required, for example, if the concentration of Lys-Lys is 50 mM of Lys-Lys or less.

Thus, in some examples of co-formulations provided herein, the co-formulations contain a therapeutically effective amount of a hyaluronan-degrading enzyme, such as a hyaluronidase for example a PH20 (e.g. rHuPH20). The co-formulations also contain a therapeutically effective amount of a fast-acting insulin, such as a rapid-acting (e.g. fast-acting) insulin analog. In examples of co-formulations provided herein, the co-formulations further contain Lys-Lys at a concentration of between or about between 50 mM to 120 mM, such as 50 to 80 mM, 80 mM to 100 mM or 100 mM to 120 mM, a pH of between or about between 6.5 to 8.0, for example, 6.5 to 7.8 or 6.8 to 7.8 such as between or about between 6.5 to 7.5 or 7.0 to 7.6, a buffering agent that maintains the pH range, an anti-microbially effective amount of a preservative or mixture of preservatives, and a stabilizing agent in an amount that, over the course of storage (temperature and time), retains at least 50% of the hyaluronan-degrading enzyme activity and retains at least 90% of the insulin purity, recovery and/or potency. For example, the co-formulations provided herein contain 0.0005% to 1.0% (e.g. 0.0005% to 0.005%) surfactant as a stabilizing agent. The co-formulations can optionally contain additional stabilizing agents, tonicity modifiers, an anti-oxidation agent and/or other excipients. For example, the co-formulations contain NaCl at a concentration of less than 140 mM, such as between or about between 0 mM to 100 mM, for example between or about between 0 mM to 50 mM, 10 mM to 40 mM or 20 mM to 30 mM. In some examples herein, the co-formulations are stable for at least 6 months at a temperature of from or from about 2° C. to or to about 8° C. and at least 14 days (i.e. 2 weeks) at a temperature of from or about 20° C. to or to about 30° C. Such co-formulations can be used for multi-dose injection (MDI) use. In other examples, the co-formulations provided herein are stable under accelerated conditions such as elevated temperatures greater than or about greater than 32° C. such as 35° C. to 40° C., in particular greater than at or about or 37° C. or 40° C. and/or agitation conditions for at least 3 hours, and generally at least 3 days. Such co-formulations can be used for continuous subcutaneous insulin infusion (CSII) methods.

a. Fast-Acting Insulin

The co-formulations provided herein contain a therapeutically effective amount of a fast-acting insulin, such as a rapid acting insulin analog. The insulin can be any fast-acting insulin as described in Section E. The fast-acting insulin can be regular insulin. In particular examples, the insulin is a fast-acting insulin that is a rapid acting insulin analog, for example, insulin lispro, insulin aspart or insulin glulisine. For example, the therapeutically effective amount can be an amount between or about between 10 Units/mL to 1000 U/mL, 100 U/mL to 1000 U/mL, or 500 U/mL to 1000 U/mL, such as at least or about at least 10 U/mL, 20 U/mL, 30 U/mL, 40 U/mL, 50 U/mL, 60 U/mL, 70 U/mL, 80 U/mL, 90 U/mL, 100 U/mL, 150 U/mL, 200 U/mL, 250 U/mL, 300 U/mL, 350 U/mL, 400 U/mL, 450 U/ml, 500 U/mL or 1000 U/mL. For example, the co-formulations provided herein contain a fast-acting insulin, such as a rapid acting insulin analog (e.g. insulin lispro, insulin aspart or insulin glulisine) in an amount that is at least or at least about or is or is about 100 U/mL.

In the stable co-formulations provided herein, the stability of the insulin, including insulin analogs, in the formulations is a function of the recovery, purity and/or activity of the insulin under storage at various temperatures (e.g. 2° C.-8° C., 20° C.-30° C. or elevated temperatures of at least or about 32° C. to 40° C.) and times (e.g. hours, days, weeks or months) or use conditions (e.g. agitation) as described herein. Assays to assess these parameters are discussed below. The formulations provided herein retain insulin recovery, purity and/or activity such that the formulations are suitable for therapeutic use as described herein. For example, in the formulations provided herein, the insulin purity (e.g. as assessed by RP-HPLC or other similar method) over time and under storage or use conditions as described herein is at least 85% of the purity of insulin in the formulation prior to storage or use, for example, at least 90%, 91%, 92%, 93%, 94%, 95%, 96%, 97%, 98%, 99% or more. Generally, for insulin purity (e.g. by RP-HPLC) the target acceptable specification is at least or about 90% purity or about or greater than 90% purity. In other examples, insulin purity can be assessed as a function of aggregation of the insulin, for example, using non-denaturing or denaturing size exclusion chromatography (SEC). In such examples, in the formulations provided herein, over time and under storage or use conditions as described herein the insulin in the formulation contains less than 2% high molecular weight (HMWt) insulin species by peak area, for example, less than 1.9%, 1.8%, 1.7%, 1.6%, 1.5%, 1.4%, 1.3%, 1.2%, 1.1%, 1.0% or less. Over time (e.g. hours, days, weeks or month) and under storage (e.g. at various temperatures and time) or use (e.g. agitation) conditions as described herein, the insulin in the formulations provided herein retains greater than or about 90%, 91%, 92%, 93%, 94%, 95%, 96%, 97%, 98%, 99% or more of its recovery or activity. Thus, in a solution formulated with 100 Units/mL insulin, at least or about 90 U/mL, 91 U/mL, 92 U/mL, 93 U/mL, 94 U/mL, 95 U/mL, 96 U/mL, 97 U/mL, 98 U/mL or 99 U/mL remains over time of hours, days, weeks or months under storage or use at temperatures of 2° C.-8° C., 20° C.-30° C. or elevated temperatures of at least or about 32° C. to 40° C. or under conditions of agitation as described herein.

b. Hyaluronan-Degrading Enzyme

The co-formulations provided herein contain a therapeutically effective amount of a hyaluronan-degrading enzyme, such as any described in Section C, for example a hyaluronidase such as a PH20 (e.g. rHuPH20). The amount of hyaluronan degrading enzyme, such as a hyaluronidase for example a PH20 (e.g. rHuPH20), in the co-formulations provided herein is an amount that is sufficient to render the composition super-fast acting. For example, the amount is functionally equivalent to at least or about at least 30 Units/mL. For example, the co-formulations provided herein contain a hyaluronan-degrading enzyme, such as a hyaluronidase for example a PH20 (e.g. rHuPH20) in an amount between or about between 30 Units/mL to 20,000 U/mL, 300 U/mL to 15,000 U/mL, 300 U/mL to 10,000 U/mL, 300 U/mL to 5,000 U/mL, 300 U/mL to 3000 U/mL, 300 U/mL to 2000 U/mL, 600 U/mL to 20,000 U/mL, 600 U/mL to 15,000 U/mL, 600 U/mL to 10,000 U/mL, 600 U/mL to 6000 U/mL, 600 U/mL to 4000 U/mL, 600 U/mL to 2000 U/mL, 600 U/mL to 1000 U/mL, 60 U/mL to 600 U/mL, or 100 U/mL to 300 U/mL, such as at least or about at least 30 U/mL, 35 U/mL, 40 U/mL, 50 U/mL, 100 U/mL, 200 U/mL, 300 U/mL, 400 U/mL, 500 U/mL, 600 U/mL, 700 U/mL, 800 U/mL, 900 U/mL, 1000 U/ml, 2000 U/mL, 3000 U/mL, 4000 U/mL, 5000 U/mL, 6000 U/mL, 7000 U/mL, 8000 U/mL, 9000 U/mL, 10,000 U/mL, 12,000 U/mL, 15,000 U/mL or 20,000 U/mL. For example, the co-formulations provided herein contain a PH20 (e.g. rHuPH20) that is in an amount that is at least 100 U/mL to 1000 U/mL, for example at least or about at least or about or 600 U/mL.

In the co-formulations provided herein the stability of a hyaluronan-degrading enzyme, including a hyaluronidase such as a PH20 (e.g. rHuPH20), in the formulations is a function of the recovery and/or activity of the enzyme under storage at various temperatures (e.g. 2° C.-8° C., 20° C.-30° C. or elevated temperatures of at least or about 32° C. to 40° C.) and times (e.g. hours, days, weeks or months) or use conditions (e.g. agitation) as described herein. Assays to assess these parameters are discussed below. The formulations provided herein retain hyaluronidase recovery and/or activity such that the formulations are suitable for therapeutic use as described herein. In the stable co-formulations provided herein, the activity of the hyaluronan degrading enzyme, such as a hyaluronidase, for example a PH20, typically is greater than or about 50%, such as greater than or at least 55%, 60%, 65%, 70%, 80%, 90%, 91%, 92%, 93%, 94%, 95%, 96%, 97%, 98%, 99% or more of the activity of enzyme in the formulation prior to storage or use. Generally, for hyaluronidase activity the target acceptable specification for stability is at least 62% of the initial activity of the enzyme for hours, days, weeks or months under storage or use at temperatures of 2° C.-8° C., 20° C.-30° C. or elevated temperatures of at least or about 32° C. to 40° C. or under conditions of agitation as described herein. Thus, for example, in a solution formulated with 600 U/mL of a hyaluronan-degrading enzyme, for example rHuPH20, at least or about at least 360 Units/mL, 365 U/mL, 370 U/mL, 375 U/mL, 380 U/mL, 390 U/mL, 420 U/mL, 480 U/mL, 540 U/mL, 546 U/mL, 552 U/mL, 558 U/mL, 564 U/mL, 570 U/mL, 576 U/mL, 582 U/mL, 588 U/mL, 594 U/mL or more activity is retained over time and under storage or use conditions. For example, in the stable co-formulations provided herein, over time and under storage or use conditions (e.g. agitation), at least 375 U/mL of hyaluronan-degrading enzyme activity is retained. In other examples, stability can be assessed as function of recovery of the enzyme, for example, using RP-HPLC. In such examples, in the formulations provided herein the hyaluronidase enzyme recovery is from between or about between 60% to 140%. For example, in the formulations provided herein the hyaluronidase enzyme recovery is from between or about between 3-7 µg/mL.

c. Preservative

For use as a multi-dose formulation, the co-formulations provided herein contain a preservative(s). As discussed above, preservatives can have a deleterious effect on the solubility of insulin and the stability and activity of hyaluronan degrading enzymes, such as a PH20 (e.g. rHuPH20), while at the same time stabilizing the hexameric insulin molecules and being necessary as an anti-microbial agent in multidose formulations. Thus, one of the objects herein is to identify the type and concentration of preservative(s) that can be used in stable co-formulations of insulin, including rapid acting insulin analogs, and hyaluronan degrading enzymes, such as soluble hyaluronidases (e.g. rHuPH20).

The one or more preservatives present in the co-formulation cannot substantially destabilize the hyaluronan degrading enzyme, such as a hyaluronidase for example a PH20 (e.g. rHuPH20), so that it loses its activity over storage conditions (e.g. over time and at varied temperature) as described herein. Further, these preservatives must be present in a sufficient concentration to stabilize the insulin hexamers and exert the required anti-microbial effect, but not be so concentrated as to decrease solubility of the insulin. Importantly, the preservatives must be present in a sufficient concentration to provide the anti-microbial requirements of, for example, the United States Pharmacopoeia (USP) and the European Pharmacopoeia (EP). Table 23, in Example 7E below, sets forth these requirements, including the minimum EP anti-microbial requirements (EPA) and the preferred EP anti-microbial requirements (EPB). Typically, formulations that meet EP (EPA or EPB) anti-microbial requirements contain more preservative than those formulated only to meet USP anti-microbial requirements.

Hence, the co-formulations provided herein contain preservative(s) in an amount that exhibits anti-microbial activity by killing or inhibiting the propagation of microbial organisms in a sample of the composition as assessed in an antimicrobial preservative effectiveness test (APET). One of skill in the art is familiar with the antimicrobial preservative effectiveness test and standards to be meet under the USP and EPA or EPB in order to meet minimum requirements. In general, the antimicrobial preservative effectiveness test involves challenging a composition, e.g., a co-formulation provided herein, with prescribed inoculums of suitable microorganisms, i.e., bacteria, yeast and fungi, storing the inoculated preparation at a prescribed temperature, withdrawing samples at specified intervals of time and counting the organisms in the sample (see, Sutton and Porter, (2002) *PDA Journal of Pharmaceutical Science and Technology* 5(6): 300-311; The United States Pharmacopeial Convention, Inc., (effective Jan. 1, 2002), *The United States Pharmacopeia* 25$^{th}$ *Revision,* Rockville, Md., Chapter <51>Antimicrobial Effectiveness Testing; and European Pharmacopoeia, Chapter 5.1.3, Efficacy of Antimicrobial Preservation). The microorganisms used in the challenge generally include three strains of bacteria, namely *E. coli* (ATCC No. 8739), *Pseudomonas aeruginosa* (ATCC No. 9027) and *Staphylococcus aureus* (ATCC No. 6538), yeast (*Candida albicans* ATCC No. 10231) and fungus (*Aspergillus niger* ATCC No. 16404), all of which are added such that the inoculated composition contains $10^5$ or $10^6$ colony forming units (cfu) of microorganism per mL of composition. The preservative properties of the composition are deemed adequate if, under the conditions of the test, there is a significant fall or no increase, as specified in Table 6, below, in the number of microorganisms in the inoculated composition after the times and at the temperatures prescribed. The criteria for evaluation are given in terms of the log reduction in the number of viable microorganism as compared to the initial sample or the previous timepoint.

TABLE 6

USP and EP requirements for antimicrobial effectiveness testing

Criteria for passage

USP

| | |
|---|---|
| Bacteria | Not less than 1.0 log reduction from the initial calculated count at 7 days, not less than 3.0 log reduction from the initial count at 14 days, and no increase from the 14 days count at 28 days. No increase is defined as not more than 0.5 $\log_{10}$ unit higher than the previous measured value. |
| Yeast or mold | No increase from the initial calculated count at 7, 14 and 28 days. No increase is defined as not more than 0.5 $\log_{10}$ unit higher than the previous measured value. |

EPA

| | |
|---|---|
| Bacteria | 2 log reduction in the number of viable microorganisms against the value obtained for the inoculum at 6 hours, a 3 log reduction in the number of viable microorganisms against the value obtained for the inoculum at 24 hours and no recovery at 28 days. |
| Yeast or mold | 2 log reduction in the number of viable microorganisms against the value obtained for the inoculum at 7 days and no increase at 28 days. No increase is defined as not more than 0.5 $\log_{10}$ unit higher than the previous measured value. |

EPB

| | |
|---|---|
| Bacteria | 1 log reduction in the number of viable microorganisms against the value obtained for the inoculum at 24 hours, a 3 log reduction in the number of viable microorganisms against the value obtained for the inoculum at 7 days and no increase at 28 days. No increase is defined as not more than 0.5 $\log_{10}$ unit higher than the previous measured value. |
| Yeast or mold | 1 log reduction in the number of viable microorganisms against the value obtained for the inoculum at 7 days and no increase at 28 days. No increase is defined as not more that 0.5 $\log_{10}$ unit higher than the previous measured value. |

Specifically, the composition, for example, the co-formulation, is aliquoted into at least 5 containers, one each for each of the bacteria or fungi (*Escherichia coli* (ATCC No. 8739), *Pseudomonas aeruginosa* (ATCC No. 9027), *Staphylococcus aureus* (ATCC No. 6538), *Candida albicans* (ATCC No. 10231) and *Aspergillus niger* (ATCC No. 16404)). Each container is then inoculated with one of the test organisms to give an inoculum of $10^5$ or $10^6$ microorganisms per mL of the composition, with the inoculum not exceeding 1% of the volume of the composition. The inoculated compositions are maintained at a temperature between 20 and 25° C. for a period of 28 days, and samples removed at 6 hours, 24 hours, 7 days, 14 days and 28 days, depending upon the criteria set forth in Table 6 above. The number of viable microorganisms (cfu) in each sample is determined by plate count or membrane filtration. Finally, the cfu for each sample is compared to either the inoculum or the previous sample and log reduction is determined.

Under USP standards, the rate or level of the anti-microbial activity of preservatives in samples inoculated with the microbial organisms is at least a 1.0 $\log_{10}$ unit reduction of bacterial organisms at 7 days following inoculation; at least a 3.0 $\log_{10}$ unit reduction of bacterial organisms at 14 days following inoculation; and at least no further increase, i.e., not more than a 0.5 $\log_{10}$ unit increase, in bacterial organisms from day 14 to day 28 following inoculation of the composition with the microbial inoculum. For fungal organisms according to USP standards, the rate or level of the anti-microbial activity of preservatives in samples inoculated with the microbial organisms is at least no increase from the initial amount after 7, 14 and 28 days following inoculation of the composition with the microbial inoculum. Under EPB, or minimum EP standards, the rate or level of the anti-microbial activity of preservatives in samples inoculated with the microbial organisms is at least 1 $\log_{10}$ unit reduction of bacterial organisms at 24 hours following inoculation; at least a 3 $\log_{10}$ unit reduction of bacterial organisms at 7 days following inoculation; and at least no further increase, i.e., not more than a 0.5 $\log_{10}$ unit increase, in bacterial organisms 28 days following inoculation of the composition with the microbial inoculum. EPA standards require at least a 2 $\log_{10}$ unit reduction of bacterial organisms at 6 hours following inoculation, with at least a 3 $\log_{10}$ unit reduction of bacterial organisms at 24 hours following inoculation, and no recovery of microbial organisms 28 days after inoculation. For fungal organisms according to minimum EPB standards, the rate or level of the anti-microbial activity of preservatives in samples inoculated with the microbial organisms is at least 1 $\log_{10}$ unit reduction of fungal organisms at 14 days following inoculation and no increase in fungal organisms at 28 days following inoculation of the composition, and increased EPA standards require a 2 $\log_{10}$ unit reduction at 7 days following inoculation and no increase in fungal organisms at 28 days following inoculation of the composition.

Non-limiting examples of preservatives that can be included in the co-formulations provided herein include, but are not limited to, phenol, meta-cresol (m-cresol), methylparaben, benzyl alcohol, thimerosal, benzalkonium chloride, 4-chloro-1-butanol, chlorhexidine dihydrochloride, chlorhexidine digluconate, L-phenylalanine, EDTA, bronopol (2-bromo-2-nitropropane-1,3-diol), phenylmercuric acetate, glycerol (glycerin), imidurea, chlorhexidine, sodium dehydroacetate, ortho-cresol (o-cresol), para-cresol (p-cresol), chlorocresol, cetrimide, benzethonium chloride, ethylparaben, propylparaben or butylparaben and any combination thereof. For example, co-formulations provided herein can contain a single preservative. In other examples, the co-formulations contain at least two different preservatives or at least three different preservatives. For example, co-formulations provided herein can contain two preservatives such as L-phenylalanine and m-cresol, L-phenylalanine and methylparaben, L-phenylalanine and phenol, m-cresol and methylparaben, phenol and methylparaben, m-cresol and phenol or other similar combinations. In one example, the preservative in the co-formulation contains at least one phenolic preservative. For example, the co-formulation contains phenol, m-cresol or phenol and m-cresol.

In the co-formulations provided herein, the total amount of the one or more preservative agents as a percentage (%) of mass concentration (w/v) in the formulation can be, for example, between from or between about from 0.1% to 0.4%, such as 0.1% to 0.3%, 0.15% to 0.325%, 0.15% to 0.25%, 0.1% to 0.2%, 0.2% to 0.3%, or 0.3% to 0.4%. Generally, the co-formulations contain less than 0.4% (w/v) preservative. For example, the co-formulations provided herein contain at least or about at least 0.1%, 0.12%, 0.125%, 0.13%, 0.14%, 0.15%, 0.16%, 0.17%, 0.175%, 0.18%, 0.19%, 0.2%, 0.25%, 0.3%, 0.325%, 0.35% but less than 0.4% total preservative.

Exemplary preservatives used in the stable co-formulations of insulin and hyaluronan degrading enzyme, such as a hyaluronidase for example a PH20 (e.g. rHuPH20) are phenol and m-cresol. In some examples, the percentage (%) of mass concentration (w/v) of phenol in the co-formulation is greater than the percentage (%) of mass concentration (w/v) of m-cresol. This is due, at least in part, to the more detrimental effects of m-cresol on the stability of the hyaluronan-degrading enzyme (e.g. rHuPH20) in solution, particularly at elevated temperatures, compared to phenol (see e.g. Example 7). Thus, in the co-formulations provided herein, the ratio as a percentage of mass concentration of phenol:meta-cresol is greater than or is about 1:1, 1.1:1, 1.2:1, 1.3:1, 1.4:1, 1.5:1, 1.6:1, 1.7:1, 1.8:1, 1.9:1, 2:1, 2.1:1, 2.2:1, 2.3:1, 2.4:1, 2.5:1, 2.6:1, 2.7:1, 2.8:1, 2.9:1, 3:1 or more.

In some examples, the stable co-formulations provided herein contain between or between about 0.1% to 0.25% phenol, and between or about between 0.05% to 0.2% m-cresol, such as between or about between 0.10% to 0.2% phenol and between or about between 0.06% to 0.18% m-cresol or between or about between 0.1% to 0.15% phenol and between or about between 0.08% to 0.15% m-cresol. For example, stable co-formulations provided herein contain or contain about 0.1% phenol and 0.075% m-cresol; 0.1% phenol and 0.15% m-cresol; 0.125% phenol and 0.075% m-cresol; 0.13% phenol and 0.075% m-cresol; 0.13% phenol and 0.08% m-cresol; 0.15% phenol and 0.175% m-cresol; or 0.17% phenol and 0.13% m-cresol.

d. NaCl

Examples of stable co-formulations provided herein of insulin and a hyaluronan-degrading enzyme, such as a hyaluronidase for example a PH20 (e.g. rHuPH20) can contain NaCl as a stabilizing agent. In co-formulations provided herein that contain NaCl as a stabilizing agent, the co-formulation can have a NaCl concentration of between or about between 50 mM to 200 mM, such as between or abut between 80 mM to 140 mM, 80 mM to 120 mM, 80 mM to 100 mM, 100 mM to 140 mM or 120 mM to 140 mM. For example, provided herein are co-formulations of insulin and a hyaluronan-degrading enzyme that contain about or at least or 50 mM, 60 mM, 70 mM, 80 mM, 85 mM, 90 mM, 95 mM, 100 mM, 105 mM, 110 mM, 115 mM, 120 mM, 125 mM, 130 mM, 135 mM, 140 mM, 150 mM, 160 mM, 170 mM, 180 mM, 190 mM or 200 mM NaCl.

In addition, it is found herein that while insulins generally are not sufficiently soluble at high NaCl concentration and low pH conditions, in which the activity of a hyaluronan-degrading enzyme is optimal, the solubility of insulin is less affected by NaCl under accelerated conditions of elevated temperature. Thus, co-formulations that are stable under accelerated conditions (e.g. elevated temperature or agitation), such as those used for CSII therapy, typically contain a higher NaCl concentration than formulations that are stable under temperatures less than 32° C.

It also is understood that in the co-formulations provided herein, the particular pH in the co-formulation can be a function of the NaCl concentrations, and vice versa. For example, in co-formulations containing a pH of or of about 7.2, for example 7.2±0.2 or lower, the co-formulations generally contain a salt concentration of or of about between 100 mM to 140 mM. In co-formulation containing a pH of or of about 7.3, for example 7.3±0.2 or higher, the co-formulations generally contain a salt concentration of or of about between 50 to 100 mM NaCl.

Also, as set forth in the Examples herein, insulin and insulin analogs each have different solubility requirements, which is influenced by the level of NaCl and pH in the formulation. Generally, insulin and insulin solubility favors high pH and low salt. For example, regular insulin forms precipitates within 1 week at high NaCl concentrations greater than 80 mM and at a low pH 7.0. But, regular insulin does not form precipitates over any time tested greater than 15 months with. NaCl concentrations of 80 mM or less and a high pH 7.6. Similarly, insulin analogs Lispro and Aspart also exhibit salt- and pH-dependent effects on solubility with precipitates generally forming at salt concentrations greater than 80 mM and at low pH of 7.2 or 7.0. In contrast, at low salt concentrations of 80 mM or less and at high pH of 7.4 or 7.6, the insulins exhibit greater stability and little to no precipitation over time. Insulin Glulisine is the most soluble. Thus, the least soluble insulins tolerate less salt compared to the most soluble insulins. Thus, because of the differing apparent solubility of different insulins, the salt concentration for the formulations provided herein can depend on the type of insulin in the formulation, as solubility of insulin is directly related to the tolerance for salt.

It is within the level of one of skill in the art, in view of the description herein, to empirically assess the solubility and stability of insulin and hyaluronan-degrading enzymes herein as a function of the NaCl concentration, the particular insulin and the required stability parameters of the particular formulation.

e. pH

Provided herein are stable co-formulations of insulin and a hyaluronan-degrading enzyme, such as a hyaluronidase for example a PH20 (e.g. rHuPH20) that have a pH of between or of about between 6.5 to 8.0, for example, 6.5 to 7.8 or 6.8 to 7.8 such as between or about between 6.5 to 7.5 or 7.0 to 7.6. Reference to pH herein is based on measurement of pH at room temperature. It is understood that the pH can change during storage over time, but typically will remain between or between about pH 6.5 to 8.0, for example between or about between 6.8 to or to about 7.8. For example, the pH can vary by ±0.1, 0.2, 0.3, 0.4, 0.5, 0.6, 0.7, 0.8, 0.9, 1.0, 1.2, 1.3, 1.4, 1.5 or more. Thus, it is understood that reference to a co-formulation that has a pH of about or at least pH 7.0, 7.1, 7.2, 7.3, 7.4 or 7.6 includes co-formulations that have a pH of or of about or at least 7.0±0.2, 7.1±0.2, 7.2±0.2, 7.3±0.2, 7.4±0.2, 7.5±0.2 or 7.6±0.2 when prepared.

Since both salt and pH are opposing parameters that influence the solubility of insulin and the activity of a hyaluronan-degrading enzyme, their inclusion in the co-formulation is accordingly balanced. Thus, for example, generally, in the formulations provided herein, the lower the salt concentration, the higher the pH. In another example of the co-formulations provided herein, the higher the salt concentration, the lower the pH. It is within the level of one of skill in the art to empirically test the pH and salt requirements in co-formulations so as to achieve a desired stability and to retain activity of a hyaluronan-degrading enzyme and solubility of an insulin as described herein. For example, optimal pH and salt requirements can be obtained by formulation techniques known to those skilled in the art and exemplified herein. For example, optimal pH and salt concentrations can be determined by assessing activity or recovery of a hyaluronan-degrading enzyme and solubility, aggregation or recovery of an insulin under differing pH or salt conditions using various methods known to one of skill in the art, for example, as described in Section H.2.

For example, as discussed elsewhere herein, it is found herein that while insulins generally are not sufficiently soluble at high salt concentration and low pH conditions, in which the activity of a hyaluronan-degrading enzyme is optimal, the solubility of insulin is less affected by low pH conditions under accelerated conditions of elevated temperature. Thus, co-formulations that are stable under accelerated conditions (e.g. elevated temperature or agitation), such as those used for CSII therapy, typically contain lower pH than formulations that are stable under temperatures less than 32° C.

If necessary, pH can be adjusted using acidifying agents to lower the pH or alkalizing agents to increase the pH. Exemplary acidifying agents include, but are not limited to, acetic acid, citric acid, sulfuric acid, hydrochloric acid, monobasic sodium phosphate solution, and phosphoric acid. Exemplary alkalizing agents include, but are not limited to, dibasic sodium phosphate solution, sodium carbonate, or sodium hydroxide.

f. Buffers

Any buffer can be used in co-formulations provided herein so long as it does not adversely affect the stability of the co-formulation, and supports the requisite pH range required. Examples of particularly suitable buffers include Tris, succinate, acetate, phosphate buffers, citrate, aconitate, malate and carbonate. Those of skill in the art, however, will recognize that formulations provided herein are not limited to a particular buffer, so long as the buffer provides an acceptable degree of pH stability, or "buffer capacity" in the range indicated. Generally, a buffer has an adequate buffer capacity within about 1 pH unit of its pK (Lachman et al. 1986). Buffer suitability can be estimated based on published pK tabulations or can be determined empirically by methods well known in the art. The pH of the solution can be adjusted to the desired endpoint within the range as described above, for example, using any acceptable acid or base.

Buffers that can be included in the co-formulations provided herein include, but are not limited to, Tris (Tromethamine), histidine, phosphate buffers, such as dibasic sodium phosphate, and citrate buffers. Generally, the buffering agent is present in an amount herein to maintain the pH range of the co-formulation between or about between 6.5 to 8.0, for example between or about between 6.8 to 7.8 such as between or about between 7.0 to 7.6. Such buffering agents can be present in the co-formulations at concentrations between or about between 1 mM to 100 mM, such as 10 mM to 50 mM or 20 mM to 40 mM, such as at or about 30 mM. For example, such buffering agents can be present in the co-formulations in a concentration of or about or at least 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 16 mM, 17 mM, 18 mM, 19 mM, 20 mM, 25 mM, 30 mM, 35 mM, 40 mM, 45 mM, 50 mM, 55 mM, 60 mM, 65 mM, 70 mM, 75 mM, or more.

Exemplary of the buffers in the co-formulations herein are non-metal binding buffers such as Tris, which reduce insulin precipitation compared to metal-binding buffers, such as phosphate buffers. The inclusion of Tris as a buffer in the co-formulations provided herein has additional benefits. For example, the pH of a solution that is buffered with Tris is affected by the temperature at which the solution is held. Thus, when the insulin and hyaluronan-degrading enzyme co-formulations are prepared at room temperature at pH 7.3, upon refrigeration, the pH increases to approximately pH 7.6. Such a pH promotes insulin solubility at a temperature where insulin is otherwise likely to be insoluble. Conversely, at increased temperatures, the pH of the formulation decreases to approximately pH 7.1, which promotes hyaluronan-degrading enzyme stability at a temperature at which the enzyme is otherwise likely to become unstable. Thus, the solubility and stability of insulin and a hyaluronan-degrading enzyme, such as a hyaluronidase for example PH20 (e.g. rHuPH20) is maximized when the co-formulations contains Tris as a buffer compared to other buffers. Further, because Tris is a positive ion, the addition of NaCl into the solution as a counter ion is not required. This also is beneficial to the overall stability of the co-formulation because NaCl at high concentrations is detrimental to insulin solubility.

For example, Tris is included in the co-formulations provided herein at a concentration of or about 10 mM to 50 mM, such as, for example, 10 mM, 15 mM, 20 mM, 25 mM, 30 mM, 35 mM, 40 mM, 45 mM or 50 mM. In particular examples, the co-formulations contain or contain about 20 mM to 30 mM Tris, such as 21 mM, 22 mM, 23 mM, 24 mM, 25 mM, 26 mM, 27 mM, 28 mM, 29 mM or 30 mM Tris. In particular examples, the co-formulations provided herein contain Tris at a concentration of or about 30 mM.

g. Lys-Lys

In examples herein, the co-formulations contain a divalent cation, and in particular lysyl-lysine (dilysine; Lys-Lys), or salt, derivative, analogue or mimetic thereof, sufficient to stabilize the hyaluronan-degrading enzyme in the co-formulation. For example, the divalent cation Lys-Lys exhibits less effects on insulin solubility than $MgCl_2$. The Lys-Lys is provided in an amount that, when combined with the preservatives, and other stabilizers at the appropriate pH, as discussed above, result in a stable co-formulation such that hyaluronan-degrading activity is retained and effects on insulin solubility is minimized as described herein above.

For example, Lys-Lys can be included in the co-formulations provide herein in an amount between or about between 50 mM to 120 mM, such as between or about between 50 to 80 mM, 80 to 100 mM or 100 to 120 mM. For example, Lys-Lys can be included in the co-formulations provided herein in an amount that is at least or at least about or is 50 mM, 60 mM, 70 mM, 80 mM, 90 mM, 100 mM, 110 mM or 120 mM.

Typically, the higher concentration of Lys-Lys the better the stability of the co-formulated containing a PH20 and insulin or insulin analogs. The particular amount of Lys-Lys in the formulation, however, can be a function of the particular insulin. For example, to achieve similar stability in a co-formulation, the insulin analog glulisine requires the least amount of Lys-Lys (e.g. 50 to 105 mM), followed by the insulin analogs aspart and lispro (e.g. 80 to 100 mM), with regular insulin requiring the highest amount (e.g. 100 to 120 mM). It is within the level of one of skill in the art, in view of the description herein, to empirically assess the solubility and stability of insulin and hyaluronan-degrading enzymes herein as a function of the Lys-Lys concentration, the particular insulin and the required stability parameters of the particular formulation.

In one example, co-formulations containing regular insulin generally contain 100 to 120 mM Lys-Lys, such as at least or about at least or 100 mM, 105 mM, 110 mM, 115 mM or 120 mM. In another example, co-formulations containing insulin aspart or insulin lispro contain 80 to 120 mM Lys-Lys, such as at least or about at least or 80 mM, 85 mM, 90 mM, 95 mM or 100 mM. In a further example, co-formulations containing insulin glulisine contain 50 to 105 mM Lys-Lys, such as at least or about at least or 50 mM, 55 mM, 60 mM, 65 mM, 70 mM, 75 mM, 80 mM, 85 mM, 90 mM, 95 mM, 100 mM or 105 mM.

Typically, in examples herein where the co-formulations contain Lys-Lys, the addition of NaCl as a stabilizer is not required to maintain stability of the components. In some cases, tonicity modifiers are required for tonicity reasons. For example, the amount of Lys-Lys in the co-formulation is less than 50 mM/mL, a tonicity modifier can be required. It is within the level of one of skill in the art to determine whether a tonicity modifier should be included in the co-formulation. As discussed below, exemplary tonicity modifiers include, but are not limited to, glycerin, NaCl, amino acids, polyalcohols, trehalose, and other salts and/or sugars. Hence, in some examples, stable co-formulations provided herein that contain Lys-Lys can optionally also contain NaCl. In such examples, the NaCl is generally less than 140 mM, and typically less than 100 mM, 90 mM, 80 mM, 70 mM, 50 mM, 40 mM, 30 mM, 20 mM, 10 mM or less. The particular amount can of tonicity modifier can be empirically determined in order to retain enzyme activity and/or tonicity.

h. Additional Exemplary Excipients or Stablizers

The co-formulations provided herein optionally can contain other components that, when combined with the preservatives, salt and stabilizers at the appropriate pH, as discussed above, result in a stable co-formulation. Other components include, for example, one or more tonicity modifiers, one or more anti-oxidation agents, zinc or other stabilizer.

For example, the stability of hyaluronan degrading enzyme, such as a hyaluronidase for example a PH20 (e.g. rHuPH20) is greatly reduced where the co-formulations contain low NaCl, high pH, the presence of preservatives and are stored at elevated temperatures (e.g. 20° C. to 30° C. or higher). Similarly, insulin stability also can be affected by these and other parameters. Such instability can be countered to some extent by the additions of one or more stabilizers. Generally, the formulations provided herein contain a stabilizer or stabilizers in an amount that, over the course of storage (temperature and time), at least 50% of the initial activity (e.g. 375 U/mL) of hyaluronan-degrading enzyme activity is retained.

Included among the types of stabilizers that can be contained in the formulations provided herein are amino acids, amino acid derivatives, amines, sugars, polyols, salts and buffers, surfactants, and other agents. The co-formulations provided herein contain at least one stabilizer. For example, the co-formulations provided herein contain at least one, two, three, four, five, six or more stabilizers. Hence, any one or more of an amino acids, amino acid derivatives, amines, sugars, polyols, salts and buffers, surfactants, and other agents can be included in the co-formulations herein. Generally, the co-formulations herein contain at least contain a surfactant and an appropriate buffer. Optionally, the co-formulations provided herein can contain other additional stabilizers.

Exemplary amino acid stabilizers, amino acid derivatives or amines include, but are not limited to, L-Arginine, Glutamine, glycine, Lysine, Methionine, Proline, Lys-Lys, Gly-Gly, Trimethylamine oxide (TMAO) or betaine. Exemplary of sugars and polyols include, but are not limited to, glycerol, sorbitol, mannitol, inositol, sucrose or trehalose. Exemplary of salts and buffers include, but are not limited to, magnesium chloride, sodium sulfate, Tris such as Tris (100 mM), or sodium Benzoate. Exemplary surfactants include, but are not limited to, poloxamer 188 (e.g. Pluronic® F68), polysorbate 80 (PS80), polysorbate 20 (PS20). Other preservatives include, but are not limited to, hyaluronic acid (HA), human serum albumin (HSA), phenyl butyric acid, taurocholic acid, polyvinylpyrolidone (PVP) or zinc.

i. Surfactant

In some examples, the co-formulations provided herein contain one or more surfactants. Such surfactants inhibit aggregation of the hyaluronan-degrading enzyme, such as a hyaluronidase for example a PH20 (e.g. rHuPH20) and minimize absorptive loss. The surfactants generally are non-ionic surfactants. Surfactants that can be included in the co-formulations herein include, but are not limited to, partial and fatty acid esters and ethers of polyhydric alcohols such as of glycerol, or sorbitol, poloxamers and polysorbates. For example, exemplary surfactants in the co-formulations herein include any one or more of poloxamer 188 (PLURONICS® such as PLURONIC® F68), TETRONICS®, polysorbate 20, polysorbate 80, PEG 400, PEG 3000, Tween® (e.g. Tween® 20 or Tween® 80), Triton® X-100, SPAN®, MYRJ®, BRIJ®, CREMOPHOR®, polypropylene glycols or polyethylene glycols. In some examples, the co-formulations herein contain poloxamer 188, polysorbate 20, polysorbate 80, generally poloxamer 188 (pluronic F68). The co-formulations provided herein generally contain at least one surfactant, such as 1, 2 or 3 surfactants.

In the co-formulations provided herein, the total amount of the one or more surfactants as a percentage (%) of mass concentration (w/v) in the formulation can be, for example, between from or between about from 0.0005% to 1.0%, such as between from or between about from 0.0005% to 0.005%, 0.001% to 0.01%, 0.01% to 0.5%, such as 0.01% to 0.1% or 0.01% to 0.02%. Generally, the co-formulations contain at least 0.0005%, 0.005%, 0.05% or 0.01% surfactant and contain less than 1.0%, such as less than 0.5% or less than 0.1% surfactant. For example, the co-formulations provided herein can contain at or about 0.0005%, 0.0001%, 0.005%, 0.001%, 0.005%, 0.01%, 0.015%, 0.02%, 0.025%, 0.03%, 0.035%, 0.04%, 0.045%, 0.05%, 0.055%, 0.06%, 0.065%, 0.07%, 0.08%, or 0.09% surfactant. In particular examples, the co-formulations provided herein contain or contain about 0.01% to or to about 0.05% surfactant.

As shown in the Examples herein, stability and enzymatic activity of a hyaluronan-degrading enzyme (e.g. rHuPH20) is generally not affected between and among different surfactants or concentrations of surfactant. Nevertheless, it is found herein that oxidation of the enzyme is increased with increasing levels of surfactant. Also, the surfactant poloxamer 188 causes less oxidation than the polysorbates. Hence, the co-formulations herein generally contain poloxamer 188. Thus, although surfactants are able to stabilize a hyaluronan-degrading enzyme, the inclusion of surfactants in the co-formulations provided herein can result in oxidation of the hyaluronan-degrading enzyme at high concentrations. Thus, generally lower concentrations of surfactant are used in the co-formulations herein, for example, as a percentage (%) of mass concentration (w/v) of less than 1.0% and generally between or about between 0.0005% to 0.1%, such as between or about between 0.01% or 0.05%. Also, as provided herein below, optionally an anti-oxidation agent can be included in the formulation to reduce or prevent oxidation.

Exemplary co-formulations provided herein contain poloxamer 188. Poloxamer 188 has a higher critical micelle concentration (cmc). Thus, use of poloxamer 188 can reduce the formation of micelles in the formulation, which can in turn reduce the effectiveness of the preservatives. Thus, among the co-formulations provided herein are those that contain or contain about 0.01% or 0.05% poloxamer 188.

In other examples, exemplary co-formulations provided herein contain polysorbate 20. For example, co-formulations provided herein contain 0.0005% to 0.1%, such as 0.0005% to 0.01%, such as at least or about at least or 0.001% polysorbate 20.

ii. Tonicity Modifier

For example, tonicity modifiers can be included in the formulation provided herein to produce a solution with the desired osmolality. The co-formulations provided herein have an osmolality of between or about between 245 mOsm/kg to 305 mOsm/kg. For example, the osmolality is or is about 245 mOsm/kg, 250 mOsm/kg, 255 mOsm/kg, 260 mOsm/kg, 265 mOsm/kg, 270 mOsm/kg, 275 mOsm/kg, 280 mOsm/kg, 285 mOsm/kg, 290 mOsm/kg, 295 mOsm/kg, 300 mOsm/kg or 305 mOsm/kg. In some examples, the co-formulations of an insulin and a hyaluronan-degrading enzyme, such as a hyaluronidase for example a PH20 (e.g. rHuPH20) have an osmolality of or of about 275 mOsm/kg.

Tonicity modifiers include, but are not limited to, glycerin, NaCl, amino acids, polyalcohols, trehalose, and other salts and/or sugars. For example, NaCl can be included in the co-formulations provided herein at a concentration of between or about between 0 mM to 200 mM, such as generally 30 mM to 100 mM, 50 mM to 160 mM, for example 50 mM to 120 mM or 80 mM to 140 mM, or 50 mM to 200 mM. Typically, when used as a tonicity modifier, for example in co-formulations containing Lys-Lys, NaCl is provided in a concentration of less than 140 mM, and generally less than 130 mM, 120 mM, 110 mM, 100 mM, 90 mM, 80 mM, 70 mM, 60 mM, 50 mM, 40 mM, 30 mM, 20 mM, 10 mM or less. The particular amount can be empirically determined in order to retain enzyme activity, insulin solubility and/or tonicity.

iii. Glycerin

In other instances, glycerin (glycerol) is included in the co-formulations. For example, co-formulations provided herein typically contain less than 60 mM glycerin, such as less than 55 mM, less than 50 mM, less than 45 mM, less than 40 mM, less than 35 mM, less than 30 mM, less than 25 mM, less than 20 mM, less than 15 mM, 10 mM or less. The amount of glycerin typically depends on the amount of NaCl present: the more NaCl present in the co-formulation, the less glycerin is required to achieve the desired osmolarity. Thus, for example, in co-formulations containing higher NaCl concentrations, such as those formulated with insulins with higher apparent solubility (e.g. insulin glulisine), little or no glycerin need be included in the formulation. In contrast, in co-formulations containing slightly lower NaCl concentrations, such as those formulated with insulins with lower apparent solubility (e.g. insulin aspart), glycerin can be included. For example, co-formulations provided herein that contain insulin aspart contain glycerin at a concentration less than 50 mM, such as 20 mM to 50 mM, for example at or about 50 mM. In co-formulations containing an even lower NaCl concentration, such as those formulated with insulins with the lowest apparent solubility (e.g. insulin lispro or regular insulin), glycerin is included at a concentration of or of about, for example, 40 mM to 60 mM.

iv Antioxidants

The co-formulations provided herein also can contain antioxidants to reduce or prevent oxidation, in particular oxidation of the hyaluronan-degrading enzyme. For example, the examples herein show that oxidation can be effected by high concentrations of surfactant or hyaluronan oligomers. Exemplary antioxidants include, but are not limited to, cysteine, tryptophan and methionine. In particular examples, the anti-oxidant is methionine. The co-formulations provided herein containing an insulin and a hyaluronan-degrading enzyme, such as a hyaluronidase for example a PH20 (e.g. rHuPH20) can include an antioxidant at a concentration from between or from about between 5 mM to or to about 50 mM, such as 5 mM to 40 mM, 5 mM to 20 mM or 10 mM to 20 mM. For example, methionine can be provided in the co-formulations herein at a concentration from between or from about between 5 mM to or to about 50 mM, such as 5 mM to 40 mM, 5 mM to 20 mM or 10 mM to 20 mM. For example, an antioxidant, for example methionine, can be included at a concentration that is or is about 5 mM, 10 mM, 11 mM, 12 mM, 13 mM, 14 mM, 15 mM, 16 mM, 17 mM, 18 mM, 19 mM, 20 mM, 21 mM, 22 mM, 23 mM, 24 mM, 25 mM, 26 mM, 27 mM, 28 mM, 29 mM, 30 mM, 35 mM, 40 mM, 45 mM or 50 mM. In some examples, the co-formulations contain 10 mM to 20 mM methionine, such as or about 10 mM or 20 mM methionine.

v. Zinc

In some instances, zinc is included in the co-formulations as a stabilizer for insulin hexamers. For example, formulations containing regular insulin, insulin lispro or insulin aspart typically contain zinc, whereas formulations containing insulin glulisine do not contain zinc. Zinc can be provided, for example, as zinc oxide, zinc acetate or zinc chloride. Zinc can be present in a composition provided herein at between or about between 0.001 to 0.1 mg per 100 units of insulin (mg/100 U), 0.001 to 0.05 mg per 100 U or 0.01 to 05 mg per 100 U. For example, the co-formulations provided herein can contain zinc at or about 0.002 milligrams per 100 units of insulin (mg/100 U), 0.005 mg/100 U, 0.01 mg/100 U, 0.012 mg/100 U, 0.014 mg/100 U, 0.016 mg/100 U, 0.017 mg/100 U, 0.018 mg/100 U, 0.02 mg/100 U, 0.022 mg/100 U, 0.024 mg/100 U, 0.026 mg/100 U, 0.028 mg/100 U, 0.03 mg/100 U, 0.04 mg/100 U, 0.05 mg/100 U, 0.06 mg/100 U, 0.07 mg/100 U, 0.08 mg/100 U or 0.1 mg/100 U.

vi. Amino Acid Stabilizer

The co-formulation provided herein also can contain an amino acid stabilizer, which contributes to the stability of the preparation. The stabilizer can be a non-polar and basic amino acids. Exemplary non-polar and basic amino acids include, but are not limited to, alanine, histidine, arginine, lysine, ornithine, isoleucine, valine, methionine, glycine and proline. For example, the amino acid stabilizer is glycine or proline, typically glycine. The stabilizer can be a single amino acid or it can be a combination of 2 or more such amino acids. The amino acid stabilizers can be natural amino acids, amino acid analogues, modified amino acids or amino acid equivalents. Generally, the amino acid is an L-amino acid. For example, when proline is used as the stabilizer, it is generally L-proline. It is also possible to use amino acid equivalents, for example, proline analogues. The concentration of amino acid stabilizer, for example glycine, included in the co-formulation ranges from 0.1 M to 1 M amino acid, typically 0.1 M to 0.75 M, generally 0.2 M to 0.5 M, for example, at least at or about 0.1 M, 0.15 M, 0.2 M, 0.25 M, 0.3 M, 0.35 M, 0.4 M, 0.45 M, 0.5 M, 0.6 M, 0.7 M, 0.75 M or more. The amino acid, for example glycine, can be used in a form of a pharmaceutically acceptable salt, such as hydrochloride, hydrobromide, sulfate, acetate, etc. The purity of the amino acid, for example glycine, should be at least 98%, at least 99%, or at least 99.5% or more.

vii. Hyaluronidase Inhibitor

In some examples of co-formulations provided herein, stability of a hyaluronan-degrading enzyme and a fast-acting insulin at a temperature of from or about 20° C. to or to about 30° C. for at least 14 days (i.e. 2 weeks) as described herein above can be increased by including a hyaluronidase inhibitor. Such an inhibitor is generally not suitable for formulations stored at 2° C. to 8° C., since, as observed with hyaluronan (HA) herein, it can cause insulin to aggregate at lower temperatures. In some examples, a hyaluronidase inhibitor can be chosen that is suitable for use at 2° C. to 8° C.

In particular, hyaluronidase inhibitors are included in a co-formulation to stabilize the hyaluronan-degrading enzyme to the effects of phenolic preservatives. In particular examples, the hyaluronidase inhibitor is one that reacts with insulin or hyaluronan-degrading enzyme in an associative and non-covalent manner, and does not form covalent complexes with insulin or a hyaluronan-degrading enzyme. The hyaluronidase inhibitor is provided at least at its equilibrium concentration. One of skill in the art is familiar with various classes of hyaluronidase inhibitors (see e.g. Girish et al. (2009) Current Medicinal Chemistry, 16:2261-2288, and references cited therein). One of skill in the art knows or can determine by standard methods in the art the equilibrium concentration of a hyaluronidase inhibitor in a reaction or stable composition herein. The choice of hyaluronidase inhibitor will depend on the particular hyaluronan-degrading enzyme used in the composition. For example, hyaluronan is an exemplary hyaluronidase inhibitor for use in the stable compositions herein when the hyaluronan-degrading enzyme is a PH20.

Exemplary hyaluronidase inhibitors for use as stabilizing agents herein include, but are not limited to, a protein, glycosaminoglycan (GAG), polysaccharides, fatty acid, lanostanoids, antibiotics, anti-nematodes, synthetic organic compounds or a plant-derived bioactive component. For example, a hyaluronidase plant-derived bioactive component can be an alkaloid, antioxidant, polyphenol, flavonoids, terpenoids and anti-inflammatory drugs. Exemplary hyaluronidase inhibitors include, for example, serum hyaluronidase inhibitor, *Withania somnifera* glycoprotein (WSG), heparin, heparin sulfate, dermatan sulfate, chitosans, β-(1,4)-galacto-oligosaccharides, sulphated verbascose, sulphated planteose, pectin, poly(styrene-4-sulfonate), dextran sulfate, sodium alginate, polysaccharide from *Undaria pinnatifida*, mandelic acid condensation polymer, eicosatrienoic acid, nervonic acid, oleanolic acid, aristolochic acid, ajmaline, reserpine, flavone, desmethoxycentauredine, quercetin, apigenin, kaempferol, silybin, luteolin, luteolin-7-glucoside, phloretin, apiin, hesperidin, sulphonated hesperidin, calycosin-7-O-β-D-glucopyranoside, sodium flavone-7-sulphate, flavone 7-fluoro-4'-hydroxyflavone, 4'-chloro-4,6-dimethoxychalcone, sodium 5-hydroxyflavone 7-sulphate, myricetin, rutin, morin, glycyrrhizin, vitamin C, D-isoascorbic acid, D-saccharic 1,4-lactone, L-ascorbic acid-6-hexadecanoate (Vcpal), 6-O-acylated vitamin C, catechin, nordihydroguaiaretic acid, curcumin, N-propyl gallate, tannic acid, ellagic acid, gallic acid, phlorofucofuroeckol A, dieckol, 8,8'-bieckol, procyanidine, gossypol, celecoxib, nimesulide, dexamethasone, indomethcin, fenoprofen, phenylbutazone, oxyphenbutazone, salicylates, disodium cromoglycate, sodium aurothiomalate, transilist, traxanox, ivermectin, linocomyc in and spectinomycin, sulfamethoxazole and trimerthoprim, neomycin sulphate, 3α-acetylpolyporenic acid A, (25S)-(+)-12α-hydroxy-3α-methylcarboxyacetate-24-methyllanosta-8,24(31)-diene-26-oic acid, lanostanoid, polyporenic acid c, PS53 (hydroquinone-sulfonic acid-formaldehyde polymer), polymer of poly (styrene-4-sulfonate), VERSA-TL 502, 1-tetradecane sulfonic acid, mandelic acid condensation polymer (SAMMA), 1,3-diacetylbenzimidazole-2-thione, N-monoacylated benzimidazol-2thione, N,N'-diacylated benzimidazol-2-thione, alkyl-2-phenylindole derivate, 3-propanoylbenzoxazole-2-thione, N-alkylated indole derivative, N-acylated indole derivate, benzothiazole derivative, N-substituted indole-2- and 3-carboxamide derivative, halogenated analogs (chloro and fluoro) of N-substituted indole-2- and 3-carboxamide derivative, 2-(4-hydroxyphenyl)-3-phenylindole, indole carboxamides, indole acetamides, 3-benzolyl-1-methyl-4-phenyl-4-piperidinol, benzoyl phenyl benzoate derivative, 1-arginine derivative, guanidinum HCL, L-NAME, HCN, linamarin, amygdalin, hederagenin, aescin, CIS-hinokiresinol and 1,3-di-p-hydroxyphenyl-4-penten-1-one.

In some examples, the stabilizing agent that is a hyaluronidase inhibitor is a polysaccharide of N-acetylglucosamine and glurcuronic acid. In another example, the stabilizing agent that is a hyaluronidase inhibitor is an amine sugar with a negatively charged sugar. In further examples, the stabilizing agent that is a hyaluronidase inhibitor is an aminomethyl indole or an ascorbic acid derivative.

Exemplary co-formulations provided herein contain a stabilizing agent that is hyaluronan (hyaluronic acid; HA). Hyaluronic acid (HA, also known as hyaluronan and hyaluronate) is the natural substrate for hyaluronan degrading enzymes such as a hyaluronidase, for example a PH20, including rHuPH20. HA is a non-sulfated glycosaminoglycan that is widely distributed throughout connective, epithelial, and neural tissues. It is a polymer of up to 25,000 disaccharide units, themselves composed of D-glucuronic acid and D-N-acetylglucosamine. The molecular weight of HA ranges from about 5 kDa to 200,000 kDa. By catalyzing the hydrolysis of hyaluronan, rHuPH20 (and other hyaluronidases and hyaluronan degrading enzymes) lowers the viscosity of hyaluronan, thereby increasing tissue permeability and increasing the absorption rate of fluids administered parenterally.

As demonstrated herein, hyaluronic acid (HA) is an efficient stabilizer of hyaluronan degrading enzymes in the presence of otherwise destabilizing agents and conditions, such as, for example, low salt, high pH, the presence of preservatives and elevated temperatures. In particular, HA appears to reduce or negate the negative affect that higher pH and/or elevated temperatures typically have on rHuPH20 and other soluble hyaluronidases and hyaluronan degrading enzymes, particularly in the presence of phenolic preservatives. For example, as shown in the studies described below (see e.g. Example 10D and Example 15), rHuPH20 stability increases significantly when HA oligomers (4-16mers) are included in the co-formulations with insulin. Increasing concentrations of HA have increasing stabilizing properties. For example, after 1 week at 30° C. at pH 7.1 with 1 mg/mL HA and 75 mM NaCl, the activity of the rHuPH20 in the rHuPH20/insulin co-formulation decreased from 600 U/mL to 341 U/mL (i.e. retained 57% of the original activity). When the HA concentration was increased to 10 mg/mL, the activity of the rHuPH20 only decreased from 600 U/mL to 510 U/mL (i.e. retained 85% of the original activity). Further, HA reduces or negates the destabilizing effect that a high pH has on rHuPH20. For example, after 1 week at 30° C. at pH 7.1 with 5.5 mg/mL HA and 100 mM NaCl, 68% of the original rHuPH20 remained. This percentage was essentially unchanged when the pH was increased to 7.5. A similar positive impact of HA on rHuPH20 stability of rHuPH20 was observed at elevated temperatures (see e.g. Example 15). Thus, it is determined herein that HA can be included in formulations of insulin and rHuPH20 (or other soluble hyaluronidases and hyaluronan degrading enzymes) to effectively stabilize rHuPH20.

Thus, provided herein are co-formulations containing HA. Any size HA can be used in the compositions as a stabilizer. In some examples, the HA is a disaccharide, composed of D-glucuronic acid and D-N-acetylglucosamine. In other examples, the HA is an oligosaccharide, such as a tetrasaccharide, containing 2 repeating disaccharide units, or alternatively, the HA used in the co-formulations provided herein can contain multiple repeating disaccharide units, such as 3, 4, 5, 6, 7, 8, 9, 10, 11, 12, 13, 14, 15, 16, 17, 18, 19, 20, 25, 30 or more disaccharide units. In other example, the HA used in the co-formulations provided herein has a molecular weight that is from or from about 5 kDa to or to about 5,000 kDa; from or from about 5 kDa to or to about 1,000 kDa; from or from about 5 kDa to or to about 500 kDa; or from or from about 5 kDa to or to about 200 kDa. Exemplary HA oligosaccharides for use in the co-formulations herein have a molecular weight of or of about 6.4 kDa, 74.0 kDa. or 234.4 kDa. For example, included among the compositions provided herein of insulin and a hyaluronan degrading enzyme, such as a hyaluronidase (e.g. rHuPH20), are those that contain HA having a molecular weight of at least or about 5 kDa, 6 kDa, 7 kDa, 8 kDa, 9 kDa, 10 kDa, 15 kDa, 20 kDa, 30 kDa, 40 kDa, 50 kDa, 60 kDa, 70 kDa, 80 kDa, 90 kDa, 100 kDa, 120 kDa, 140 kDa, 160 kDa, 180 kDa, 200 kDa, 220 kDa, 240 kDa, 260 kDa, 280 kDa, 300 kDa, 350 kDa, 400 kDa, 450 kDa, or 500 kDa. In one example, the molecular weight of the HA in the co-formulation is less than 10 kDa.

Provided herein, therefore, are co-formulations of insulin and a hyaluronan-degrading enzyme, such as a hyaluronidase for example a PH20 (e.g. rHuPH20) that contain an HA oligosaccharide. The co-formulations contain 1 mg/mL to 20 mg/mL HA, such as at least or about 1 mg/mL, 2 mg/mL, 3 mg/mL, 4 mg/mL, 5 mg/mL, 6 mg/mL, 7 mg/mL, 8 mg/mL, 9 mg/mL, 10 mg/mL, 11 mg/mL, 12 mg/mL, 13 mg/mL, 14 mg/mL, 15 mg/mL, 16 mg/mL, 17 mg/mL, 18 mg/mL, 19 mg/mL or 20 mg/mL or more HA. Exemplary stable co-formulations of insulin and rHuPH20 include from or from about 8 mg/mL to or to about 12 mg/mL HA, such as, for example 10 mg/mL or about 10 mg/mL. In some examples, the molar ratio of HA to hyaluronan degrading enzyme is or is about 100,000:1, 95,000:1, 90,000:1, 85,000:1, 80,000:1, 75,000:1, 70,000:1, 65,000:1, 60,000:1, 55,000:1, 50,000:1, 45,000:1, 40,000:1, 35,000:1, 30,000:1, 25,000:1, 20,000:1, 15,000:1, 10,000:1, 5,000:1, 1,000:1, 900:1, 800:1, 700:1, 600:1, 500:1, 400:1, 300:1, 200:1, or 100:1 or less.

viii. Nicotinic Compound

In some examples, a nicotinic compound is used as a stabilizing agent. Nicotinic compounds include, but are not limited to, nicotinamide, nicotinic acid, niacin, niacinamide, vitamin B3 and/or salts thereof and/or any combination thereof. In particular applications, the stabilizing agent can include a nicotinic compound and an amino acid or amino acids (see e.g. International published PCT Appl. No. WO2010149772). For example, the amino acid can be arginine, glutamic acid and/or salts thereof or combinations thereof.

ix. Other Excipients or Agents

Optionally, the co-formulations can include carriers such as a diluent, adjuvant, excipient, or vehicle with which the co-formulation is administered. Examples of suitable pharmaceutical carriers are described in "Remington's Pharmaceutical Sciences" by E. W. Martin. Such compositions will contain a therapeutically effective amount of the compound, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions.

For example, pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (Tween 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidone, celluloses and derivatives thereof, povidone, crospovidones and other such binders known to those of skill in the art.

For example, an excipient protein can be added to the co-formulation that can be any of a number of pharmaceutically acceptable proteins or peptides. Generally, the excipient protein is selected for its ability to be administered to a mammalian subject without provoking an immune response. For example, human serum albumin is well-suited for use in pharmaceutical formulations. Other known pharmaceutical protein excipients include, but are not limited to, starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. The excipient is included in the formulation at a sufficient concentration to prevent adsorption of the protein to the holding vessel or vial. The concentration of the excipient will vary according to the nature of the excipient and the concentration of the protein in the co-formulation.

A composition, if desired, also can contain minor amounts of wetting or emulsifying agents, or pH buffering agents, for example, acetate, sodium citrate, cyclodextrin derivatives, sorbitan monolaurate, triethanolamine sodium acetate, triethanolamine oleate, and other such agents.

2. Exemplary Stable Co-Formulations a. Exemplary Multi-Dose Injection (MDI) Co-Formulations Provided herein are stable co-formulations of a fast acting insulin, such as a rapid acting (fast-acting) insulin analog, and a hyaluronan degrading enzyme, such as a hyaluronidase for example a PH20 (e.g. rHuPH20) that are stable for at least 6 months at a temperature of from or from about 2° C. to or to about 8° C. and at least 14 days (i.e. 2 weeks) at a temperature of from or about 20° C. to or to about 30° C. Exemplary of the MDI co-formulations are those that are stable for at least or about 6, 7, 8, 9, 10, 15, 20, 24, 30, 36, 42, 48, 54, 60 or more months at a temperature of from or from about 2° C. to or to about 8° C., and for at least or about 14, 15, 20, 25, 28, 30, 35, 40, 45 or 50 or more days at a temperature of from or about 20° C. to or to about 30° C.

For example, the formulations provided herein are stable at or at about 2-8° C. for at least one year, for example at least 12 months, 13 months, 14 months, 15 months, 16 months, 17 months, 18 months, 19 months, 20 months, 21 months, 22 months, 23 months, 24 months, 25 months, 26 months, 27 months, 28 months, 29 months, 30 months, 31 months, 32 months, 33 months, 34 months, 35 months, 36 months or more. In particular, the formulations provided herein are stable at or at about 2-8° C. for at least 24 months.

In other examples, the formulations provided herein are stable for at least one week at or at about 20-30° C., such as at or about 22° C., 23° C., 24° C., 25° C., 26° C., 27° C., 28° C., 29° C. or 30° C., for at least one week. For example, formulations provided herein are stable at or at about 20-30° C. for at least 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, one month, 2 months, 3 months, 4 months, 5 months, 6 months or more. In particular, the formulations provided herein are stable at or at about 20-30° C., such as at or about 25° C. or 30° C. for at least one month.

In some examples, a stable co-formulation provided herein contains 100 U/mL to 1000 U/mL of a hyaluronan-degrading enzyme such as a hyaluronidase for example a PH20 (e.g. rHuPH20), and in particular at or about or at least 600 U/mL; 10 U/mL to 1000 U/mL of a fast-acting insulin, and in particular at least or about 100 U/mL; NaCl at a concentration between or about between 50 mM to 200 mM; a pH of between or about between 6.8 to 7.8, such as between or about between 7.0 to 7.6; a buffering agent that maintains the pH range of between or about between 6.8 to 7.8 or 7.0 to 7.6; an anti-microbially effective amount of a preservative or a mixture of preservatives of 0.1% to 0.4% preservative as a mass concentration (w/v); and a stabilizing agent in an amount that, over the course of storage (temperature and time), at least 50% of the initial hyaluronan-degrading enzyme activity, such as at least or about at least 375 U/mL of hyaluronan-degrading enzyme activity is retained. With respect to the buffering agent, any buffering agent can be used that can be included in an amount to maintain the pH range of the co-formulation between or about between 6.8 to 7.8 such as between or about between 7.0 to 7.6. Typically, Tris is included in the co-formulations provided herein at a concentration of or about 10 mM to 50 mM, such as, for example, 10 mM, 15 mM, 20 mM, 25 mM, 30 mM, 35 mM, 40 mM, 45 mM or 50 mM. In particular examples, the co-formulations contain or contain about 20 mM to 30 mM Tris, such as 21 mM, 22 mM, 23 mM, 24 mM, 25 mM, 26 mM, 27 mM, 28 mM, 29 mM or 30 mM Tris. In particular examples, the co-formulations provided herein contain Tris at a concentration of or about 30 mM.

For example, exemplary of such formulations contain 100 U/mL to 1000 U/mL of a hyaluronan-degrading enzyme such as a hyaluronidase for example a PH20 (e.g. rHuPH20), and in particular at or about or at least 600 U/mL; 10 U/mL to 1000 U/mL of a fast-acting insulin, and in particular at least or about 100 U/mL; NaCl at a concentration of between or about between 80-140 mM; a pH of between or about between 7.0 to 7.6; a buffering agent that maintains the pH range of between or about between 7.0 to 7.6; 0.1% to 0.4% preservative as a mass concentration (w/v); and a stabilizing agent in an amount that, over the course of storage (temperature and time), at least 50% of the initial hyaluronan-degrading enzyme activity is retained, such as at least or about at least 375 U/mL of hyaluronan-degrading enzyme activity is retained. For example, the co-formulations provided herein contain 1 mM to 100 mM of a buffering agent (e.g. Tris). For example, the co-formulations provided herein contain 0.01% to 0.5% surfactant. Exemplary co-formulations provided herein also can contain less than 60 mM glycerin (glycerol) and 5 mM to or to about 50 mM of an antioxidant.

The following stable formulations are exemplary only and provide a platform from which minor adjustments can be made. It is understood that very small changes in the concentrations of the various excipients and other components (e.g. ±15% of the stated concentrations), or small changes in pH, can be made while retaining some if not all of the insulin solubility and stability and hyaluronan degrading enzyme stability. Further changes also can be made by adding or removing excipients. For example, the type of stabilizing surfactant can be changed. For example, the exemplary co-formulations herein contain 100 U/mL to 1000 U/mL of a hyaluronan-degrading enzyme such as a hyaluronidase for example a PH20 (e.g. rHuPH20), and in particular at least or about at least or about 600 U/mL of a hyaluronan-degrading enzyme such as a hyaluronidase for example a PH20 (e.g. rHuPH20); 10 U/mL to 1000 U/mL of a fast-acting insulin, and in particular at least or about at least or about 100 U/mL of a fast-acting insulin; from or from about 10 mM to or to about 50 mM Tris (e.g. from or from about 20 mM to 40 mM Tris, such as at least or about at least 20 mM, 25 mM, 30 mM, 35 mM or 40 mM); from or from about 80 mM to or to about 140 mM NaCl (e.g. at least or about at least 80 mM, 90 mM, 100 mM, 110 mM 120 mM, 130 mM, 140 mM, 150 mM or 160 mM NaCl); from or from about 5 mM to or to about 50 mM methionine (e.g. at least or about at least 5 mM, 10 mM, 20 mM, 30 mM, 40 mM or 50 mM methionine); from or from about 0 mM to or to about 50 mM glycerin (e.g. at least or about at least 5 mM, 10 mM, 20 mM, 30 mM, 40 mM or 50 mM glycerin); from or from about 0.01% to or to about 0.5% poloxamer 188, such as 0.01% to 0.05% (e.g. at least or about at least 0.01%, 0.02%, 0.03%, 0.04% or 0.05% poloxamer 188); from or from about 0.1% to or to about 0.25% phenol (e.g. at least or about at least 0.1%, 0.12%, 0.125%, 0.13%, 0.14%, 0.15%, 0.16% or 0.17% phenol); and from or from about 0.05% to or to about 0.2% m-cresol (e.g. at least or about at least 0.075%, 0.08%, 0.09%, 0.1%, 0.12%, 0.13%, 0.14%, 0.15%, 0.16% or 0.17% m-cresol). The formulations are prepared with a pH from or from about 7.0 to or to about 7.6 (e.g. at least or about at least pH 7.0, 7.1, 7.2, 7.3, 7.4, 7.5 or 7.6). In further examples, zinc is included at a concentration of or about 0.017 mg/100 U, 0.018 mg/100 U, 0.02 mg/100 U, 0.022 mg/100 U or 0.024 mg/100 U insulin.

As discussed above, the concentrations of the various components in the formulations can be increased or decreased depending upon the particular properties of the insulin. For example, formulations of insulins with higher apparent solubility, such as insulin aspart, typically contain a higher concentration of NaCl and a lower concentration of glycerin compared to formulations of insulins with lower apparent solubility, such as insulin lispro. Depending on the NaCl concentration, the particular pH of the formulation also can vary between different insulins.

For example, included among stable co-formulations provided herein are stable co-formulations of an insulin and a hyaluronan-degrading enzyme, such as a hyaluronidase for example a PH20 (e.g. rHuPH20) that contains between or about between 50 to 120 mM NaCl, for example 50 mM to 100 mM, such as 50 mM to 90 mM or 80 mM to 100 mM. Such co-formulations include those that contain insulin analogs insulin lispro. In other examples, stable co-formulations provided herein are stable co-formulations of an insulin and a hyaluronan-degrading enzyme, such as a hyaluronidase for example a PH20 (e.g. rHuPH20) that contains between or about between 80 mM to 160 mM NaCl, such as 100 mM to 140 mM for example 120 mM. Such co-formulations include those that contain insulin aspart. For example provided herein are co-formulations of rHuPH20 and insulin aspart or insulin lispro that contain or contain about 80 mM or 100 mM NaCl.

In another example, included among stable co-formulations provided herein are stable co-formulations of an insulin and a hyaluronan-degrading enzyme, such as a hyaluronidase for example a PH20 (e.g. rHuPH20) that contains between or about between 80 mM to 200 mM, for example, 100 mM to 150 mM, such as 130 mM to 150 mM, 120 mM to 140 mM or 110 mM to 130 mM. Such co-formulations include those that contain the insulin analog glulisine. In some examples, the co-formulations containing, for example insulin glulisine, have a salt (NaCl) concentration of or of about 80 mM, 90 mM, 100 mM, 110 mM, 120 mM, 121 mM, 122 mM, 123 mM, 124 mM, 125 mM, 126 mM, 127 mM, 128 mM, 129 mM, 130 mM, 131 mM, 132 mM, 133 mM, 134 mM, 135 mM, 136 mM, 137 mM, 138 mM, 139 mM, 140 mM, 150 mM, 160 mM, 170 mM, 180 mM, 190 mM or 200 mM. For example provided herein are co-formulations of rHuPH20 and insulin glulisine that contain or contain about 120 mM or 140 mM NaCl.

In examples of co-formulations provided herein are co-formulations of an insulin, such as insulin aspart, and rHuPH20 that have a pH of or of about 7.2, for example 7.2±0.2. In other examples, the co-formulations of an insulin, such as insulin lispro, and rHuPH20 have a pH of or of about 7.4, for example 7.4±0.2. In further examples, the co-formulations of an insulin, such as insulin glulisine, and rHuPH20 have a pH of or of about 7.3 or 7.4, for example 7.3±0.2 or 7.4±0.2.

Exemplary of the co-formulations provided herein that contain a hyaluronan degrading enzyme, such as a hyaluronidase for example a PH20 (e.g. rHuPH20), and insulin lispro are those that contain from or about 25 mM to or to about 35 mM Tris (e.g. at or about 30 mM); from or from about 70 mM to or to about 100 mM NaCl (e.g. at or about 80 mM or 100 mM NaCl); from or from about 10 mM to or to about 30 mM methionine (e.g. at or about 10 mM or 20 mM methionine); from or from about 40 mM to or to about 60 mM glycerin (e.g. at or about 50 mM glycerin); from or from about 0.005% to or to about 0.05% poloxamer 188 (e.g. at or about 0.01% poloxamer 188); from or from about 0.017 mg zinc/100 U insulin to or to about 0.024 mg zinc/100 U insulin (e.g. 0.017 mg zinc/100 U insulin, 0.018 mg/100 U, 0.02 mg/100 U, 0.022 mg/100 U or 0.024 mg zinc/100 U insulin); from or from about 0.08% to or to about 0.17% phenol (e.g. 0.1%, 0.125% or 0.13% phenol); and from or from about 0.07% to or to about 0.17% m-cresol (e.g. 0.075%, 0.08%, 0.13% or 0.15% m-cresol). For example, the co-formulations can contain at or about 0.1% phenol and 0.015% m-cresol; at or about 0.125% phenol and 0.075% m-cresol; at or about 0.13% phenol and 0.075% m-cresol; at or about 0.13% phenol and 0.08% m-cresol; or at or about 0.17% phenol and 0.13% m-cresol. Such formulations of insulin lispro and a hyaluronan degrading enzyme, such as a soluble hyaluronidase (e.g. rHuPH20), are prepared with a pH of or of about 7.0 to or to about 7.5 (typically a pH of or about pH 7.2).

Exemplary of the co-formulations provided herein that contain a hyaluronan degrading enzyme, such as a hyaluronidase for example a PH20 (e.g. rHuPH20), and insulin aspart are those that contain from or from about 25 mM to or to about 35 mM Tris (e.g. at or about 30 mM); from or from about 70 mM to or to about 100 mM NaCl (e.g. at or about 80 mM or 100 mM NaCl); from or from about 10 mM to or to about 30 mM methionine (e.g. at or about 10 mM or 20 mM methionine); from or from about 40 mM to or to about 60 mM glycerin (e.g. at or about 50 mM glycerin); from or from about 0.005% to or to about 0.05% poloxamer 188 (e.g. at or about 0.01% poloxamer 188); from or from about 0.017 mg zinc/100 U insulin to or to about 0.024 mg zinc/100 U insulin (e.g. 0.017 mg zinc/100 U insulin, 0.018 mg/100 U, 0.02 mg/100 U, 0.022 mg/100 U or 0.024 mg zinc/100 U insulin); from or from about 0.08% to or to about 0.17% phenol (e.g. 0.1%, 0.125% or 0.13% phenol); and from or from about 0.07% to or to about 0.17% m-cresol (e.g. 0.075%, 0.08%, 0.13% or 0.15% m-cresol). For example, the co-formulations can contain at or about 0.1% phenol and 0.015% m-cresol; at or about 0.125% phenol and 0.075% m-cresol; at or about 0.13% phenol and 0.075% m-cresol; at or about 0.13% phenol and 0.08% m-cresol; or at or about 0.17% phenol and 0.13% m-cresol. Such formulations of insulin aspart and a hyaluronan degrading enzyme, such as a hyaluronidase for example a PH20 (e.g. rHuPH20) are prepared with a pH of or of about 7.0 to or to about 7.6 (typically a pH of or about pH 7.4).

Exemplary of the co-formulations provided herein that contain a hyaluronan degrading enzyme, such as a hyaluronidase for example a PH20 (e.g. rHuPH20), and insulin glulisine are those that contain from or from about 25 mM to or to about 35 mM Tris (e.g. at or about 30 mM); from or from about 100 mM to or to about 150 mM NaCl (e.g. at or about 100 mM or 140 mM NaCl); from or from about 10 mM to or to about 30 mM methionine (e.g. at or about 10 mM or 20 mM methionine); from or from about 40 mM to or to about 60 mM glycerin (e.g. at or about 50 mM glycerin); from or from about 0.005% to or to about 0.05% poloxamer 188 (e.g. at or about 0.01% poloxamer 188); from or from about 0.08% to or to about 0.17% phenol (e.g. 0.1%, 0.125% or 0.13% phenol); and from or from about 0.07% to or to about 0.17% m-cresol (e.g. 0.075%, 0.08%, 0.13% or 0.15% m-cresol). For example, the co-formulations can contain at or about 0.1% phenol and 0.015% m-cresol; at or about 0.125% phenol and 0.075% m-cresol; at or about 0.13% phenol and 0.075% m-cresol; at or about 0.13% phenol and 0.08% m-cresol; or at or about 0.17% phenol and 0.13% m-cresol. Such formulations of insulin glulisine and a hyaluronan degrading enzyme, such as a hyaluronidase (e.g. rHuPH20) are prepared with a pH of or about 7.0 to or to about 7.6 (typically a pH of or about pH 7.4).

b. Exemplary Continuous Subcutaneous Insulin Infusion (CSII) Co-Formulations

Provided herein are stable co-formulations that are stable in the presence of accelerated or stress conditions such as elevated temperatures greater than or about greater than 32° such as 35° C. to 40° C., in particular greater than at or about or 37° C. or 40° C. and/or agitation conditions for at least 3 hours, 4 hours, 5 hours, 6 hours, 12 hours, 1 day, 2 days, 3 days, 4 days, at least 5 days, at least 6 days or at least 7 days, and generally at least 3 hours or at least 3 days. These stable co-formulations are suitable for administration by continuous subcutaneous insulin infusion (CSII).

As discussed above, the concentration, amount or level of components that confer stability of co-formulations herein for at least 6 months at temperatures of from or from about 2° C. to or to about 8° C. and at least 14 days (i.e. 2 weeks) at a temperature of from or about 20° C. to or to about 30° C. generally are not sufficient to confer stability of the co-formulation under stress conditions such as elevated temperature. Generally, such co-formulations are stable under such stress conditions (e.g. elevated temperature) for less than 24 hours, and generally less than 8 hours, which can substantially impair their use in multi-dose applications where such conditions exist. For example, CSII therapy is associated with continuous infusion of formulations by a pump or other device that is worn outside and near to the body for 24 hours a day for 2 to 3 days. The insulin formulation or co-formulation is injected through a needle into the abdominal wall or thigh, which injection can be controlled by a programmed pump so that the insulin formulation or co-formulation is infused continuously. Therefore, co-formulations used for CSII therapy are subjected to elevated body temperatures of at least or about or greater than 37° C. and agitation conditions.

For example, a hyaluronan-degrading enzyme is particularly unstable at elevated temperatures greater than 32° C., and typically greater than 37° C. or 40° C. It also is found herein that although insulin crystallizes at 2° C. to 8° C. at high salt concentrations and low pH, it does not crystallize at high salt concentrations and low pH at higher temperatures of 32° C. to 40° C. Accordingly, the opposing requirement of high salt concentration and low pH required by a hyaluronan-degrading enzymes (e.g. PH20) to maintain its stability at high temperatures of 32° C. to 40° C. is more compatible at higher temperatures for at least a short period of time of at least 3 days. Also, the same high salt and low pH formulations confer similar stability between and among the insulin analogs, despite differences in apparent solubility that affect stability of insulin at the lower temperatures.

The stable co-formulations that are stable under stress conditions, for example for use in CSII therapy, generally contain the same components as other co-formulations provided here. Such co-formulations, however, differ in that the co-formulations that are stable under stress conditions generally contain a higher salt concentration, a lower pH and/or the presence of one or more other excipients that sufficiently stabilize the hyaluronan-degrading enzyme and/or insulin generally for at least 2 to 3 days at elevated temperatures greater than or about greater than 32° such as 35° C. to 40° C., in particular greater than at or about or 37° C. or 40° C. and/or agitation conditions. For example, co-formulations provided herein that are stable at stress conditions of elevated temperatures or agitation generally contain a hyaluronidase inhibitor, such as a hyaluronidase substrate (e.g. hyaluronan) as an excipient.

In one example, the co-formulations provided herein that are stable at stress conditions of elevated temperatures or agitation contain a higher salt concentration and a lower pH than co-formulations provided above in Section E.1.a. For example, provided herein are co-formulations that are stable under stress conditions (e.g. elevated temperature of 32° C. to 40° C. or agitation) for at least 3 days or 3 hours that contain 120 mM NaCl to 200 mM NaCl and pH of 6.5 to 7.5. As discussed above, however, insulin solubility, particularly at refrigerated temperatures, decreases in these reduced pH and increased salt conditions. Thus such formulations typically are not stored at refrigerated or ambient temperatures prior to use.

In another example, the co-formulations provided herein that are stable at stress conditions of elevated temperatures (e.g. 32° C. to 40° C.) for at least 3 days or agitation for at least 3 hours contain a hyaluronidase inhibitor to stabilize the hyaluronan-degrading enzyme in the co-formulation. Any of the hyaluronidase inhibitors described above can be used in a co-formulation herein that is stable at stress conditions of elevated temperatures (e.g. 32° C. to 40° C.) for at least 3 days or agitation for at least 3 hours. In particular examples, the hyaluronidase inhibitor is a hyaluronidase substrate, for example, a hyaluronan.

As shown in the Examples herein with the hyaluronidase inhibitor hyaluronan, the presence of a hyaluronidase inhibitor stabilizes PH20 activity, particularly in the presence of preservatives especially at elevated temperatures, such as under stress conditions of temperatures of 32° C. to 40° C. Since HA oligomers are the substrate/product of the enzymatic reaction of a hyaluronan-degrading enzyme with hyaluronan, the hyaluronan oligomers can bind to the enzyme active site and cause the stabilizing effect. Nevertheless, it is also found that over time under stress conditions of elevated temperatures of 32° C. to 40° C., such as greater than 1 week or 2 weeks at 37° C., the presence of a hyaluronidase inhibitor, such as HA, in the co-formulation can result in degradation of insulin, thereby resulting in covalent HA-insulin analog adducts. For example, the presence of high concentrations of HA in the co-formulations provided herein has been shown by reverse-phase high performance liquid chromatography (RP-HPLC) to cause degradation of insulin Aspart® after 1 week at 37° C. and insulin Glulisine® after 2 weeks at 30° C. Liquid chromatography-mass spectrometry (LC-MS) analysis indicated that some of the degradation products are covalent HA-insulin analog glycation adducts formed by reaction of insulin with the reducing end of the HA. For example, one peak was determined to be the product of insulin Aspart® and a HA 7mer while another peak was the product of insulin Aspart® and a HA 2mer.

The presence of a hyaluronidase inhibitor, such as HA, also can have effects on the precipitation and color change of the co-formulation. Hence, while HA improves the stability of hyaluronan-degrading enzyme at stress conditions of elevated temperatures of 32° C. to 40° C., it also can have effects on insulin degradation, precipitation and color change of the co-formulation. It is within the level of one of skill in the art to monitor these conditions within desired safety and pharmacologic parameters and guidelines. Generally, stable co-formulations provided herein that contain a hyaluronidase inhibitor, such as HA, are stable at elevated temperatures, such as under stress conditions of temperatures of 32° C. to 40° C. for at least 3 hours but no more than 7 days due to effects on these parameters.

In some examples provided herein, a hyaluronidase inhibitor is used that is not capable of forming covalent complexes with insulin or a hyaluronan-degrading enzymes. Hence, non-covalent inhibitors that act by associative binding are contemplated in the formulations herein. For example, provided herein are co-formulations that contain HA with a reacted reducing end so that it is no longer possible to form glycation adducts with insulin. For example, in some examples, the HA used in the co-formulations provided herein has been modified by reductive amination. Reductive amination involves formation of a Schiff base between an aldehyde and amine, which is then reduced to form the more stable amine. The reducing end of a sugar, i.e., HA, exists as an equilibrium mixture of the cyclic hemiacetal form and the open chain aldehyde form. Under suitable conditions known of one of skill in the art, amine groups will condense with the sugar aldehyde to form an iminium ion which can be reduced to an amine, with a reducing agent such as sodium cyanoborohydride (see, e.g., Gildersleeve et al., (2008) *Bioconjug Chem* 19(7):1485-1490). The resulting HA is unreactive to the insulin and unable to form insulin glycation adducts.

In particular, provided herein is a stable co-formulation composition that is stable for at least 3 days at a temperature from or from about 32° C. to 40° C. and/or is stable for at least 3 hours under agitation containing 100 U/mL to 1000 U/mL of a hyaluronan-degrading enzyme such as a hyaluronidase for example a PH20 (e.g. rHuPH20), and in particular at or about or at least 600 U/mL; 10 U/mL to 1000 U/mL of a fast-acting insulin, and in particular at least or about 100 U/mL; NaCl at a concentration between or about between 120 mM to 200 mM; a pH of between or about between 6.5 to 7.5; an anti-microbially effective amount of a preservative or mixture of preservatives; and one or more further stabilizing agent or agents, such as a hyaluronidase inhibitor, such that at least 50% of the initial hyaluronan-degrading enzyme activity, such as at least or about at least 375 U/mL of hyaluronan-degrading enzyme activity is retained. For example, the co-formulation can contain HA at a concentration of between or about between 1 mg/mL to 20 mg/mL. The stable co-formulations also can contain a buffering agent to maintain the pH range of between or about between pH 6.5 (e.g. Tris) in an amount that is between or about between 1 mM to 100 mM; an anti-microbially effective amount of a preservative or a mixture of preservatives, for example, a phenolic preservative (e.g. phenol and/or m-cresol) in a total amount as a percentage (%) of mass concentration (w/v) in the formulation that is or is between 0.1% and 0.4%; a surfactant (e.g. poloxamer 188) as a % of mass concentration (w/v) of between or about between 0.005% to 1.0%; and optionally a further stabilizing agent.

For example, co-formulations provided herein that are stable under stress conditions (e.g. elevated temperature of 32° C. to 40° C. or agitation) for at least 3 days or 3 hours contain 120 mM to 200 mM, such as 150 mM NaCl to 200 mM NaCl or 160 mM NaCl to 180 mM NaCl, for example at or about 120 mM, 130 mM, 140 mM, 150 mM, 155 mM, 160 mM, 165 mM, 170 mM, 175 mM, 180 mM, 185 mM, 190 mM, 195 mM or 200 mM NaCl. Also, the co-formulations provided herein that are stable under stress conditions (e.g. elevated temperature of 32° C. to 40° C. or agitation) for at least 3 days or 3 hours contain a pH of 6.5 to 7.5 or 6.5 to 7.2, such as or about a pH of 6.5±0.2, 6.6±0.2, 6.7±0.2, 6.8±0.2, 6.9±0.2, 7.0±0.2, 7.1±0.2, 7.2±0.2, 7.3±0.2, 7.4±0.2 or 7.5±0.2.

In examples herein, co-formulations provided herein that are stable at stress conditions of elevated temperatures (e.g. 32° C. to 40° C.) or agitation for at least 3 days or 3 hours contain hyaluronan (hyaluronic acid; HA) that has a molecular weight of 5 kDa to 5,000 kDa, 5 kDa to or to about 1,000 kDa, 5 kDa to or to about 200 kDa, or 5 kDa to or to about 50 kDa. In particular, the molecular weight of HA is less than 10 kDa. The HA can be an oligosaccharide, composed of disaccharides, such as a 2mer to 30mer or a 4mer to 16mer. The co-formulations of insulin and a hyaluronan-degrading enzyme such as a hyaluronidase, for example, a PH20 (e.g. rHuPH20) contain HA at a concentration of between or about between 1 mg/mL to 20 mg/mL, such as at least or about 1 mg/mL, 2 mg/mL, 3 mg/mL, 4 mg/mL, 5 mg/mL, 6 mg/mL, 7 mg/mL, 8 mg/mL, 9 mg/mL, 10 mg/mL, 11 mg/mL, 12 mg/mL, 13 mg/mL, 14 mg/mL, 15 mg/mL, 16 mg/mL, 17 mg/mL, 18 mg/mL, 19 mg/mL or 20 mg/mL or more HA. Exemplary stable co-formulations include from or from about 8 mg/mL to or to about 12 mg/mL HA, such as, for example 10 mg/mL or about 10 mg/mL. In some examples, the molar ratio of HA to hyaluronan degrading enzyme is or is about 100,000:1, 95,000:1, 90,000:1, 85,000:1, 80,000:1, 75,000:1, 70,000:1, 65,000:1, 60,000:1, 55,000:1, 50,000:1, 45,000:1, 40,000:1, 35,000:1, 30,000:1, 25,000:1, 20,000:1, 15,000:1, 10,000:1, 5,000:1, 1,000:1, 900:1, 800:1, 700:1, 600:1, 500:1, 400:1, 300:1, 200:1, or 100:1 or less.

Since the co-formulations that are stable at elevated temperatures (e.g. 32° C. to 40° C.) or agitation, such as is desired for CSII formulations, have a pH that is decreased and the salt concentration increased as compared to the co-formulations set forth above in Section E.1.a, they can be prepared or derived therefrom. This can be achieved, for example, by diluting a co-formulation such as any provided in Section E.1.a that is suitable for MDI with a stabilizing diluent that has a low pH and a high salt concentration. For example, the diluent can be a high NaCl solution with buffer at lower pH and preservatives. For example, the diluent can contain 10 mM to 50 mM Tris or other similar buffer; 120 mM to 200 mM NaCl; 0.1% to 0.4% preservative. The diluent can be prepared at a pH of between or about between 6.5 to 7.8. Hence, a stable co-formulation provided herein that is stable at 2° C. to 8° C. or 20° C. to 30° C. can be provided and mixed with diluent to provide a co-formulation that is stable under stress conditions of elevated temperatures (e.g. 32° C. to 40° C.) for at least 3 days or agitation for at least 3 hours.

For example, any of the above MDI co-formulations in Section E.1.a can be diluted with a stabilizing diluent resulting in a CSII formulation with lower insulin concentration, a pH of from or from about 6.8 to or to about 7.0 (such as or about 6.8, 6.9 or 7.0) and a NaCl concentration of from or from about 150 mM to or to about 200 mM.

In other examples, the stable MDI co-formulation can be provided as a modified high concentration MDI formulation containing higher insulin concentrations and higher PH20 concentrations and lower NaCl (between or about between 80 mM to 150 mM) and lower buffering capacity to provide acceptable tonicity and lower pH after mixing with the stabilizing excipient diluent. For example, the higher insulin concentration can be, for example, 120 to 500 Units, such as 150, 200 or 500 Units (U) and the higher PH20 concentration can be 6 to 25 µg/mL, such as 6 to 25 6, 7.5, 10 or 25 µg/mL. Dilution of a modified high concentration MDI formulation with a stabilizing diluent can provide a CSII formulation with lower pH (e.g. 6.5 to 7.2) and increased NaCl (140 mM to 200 mM) than any of the MDI co-formulations provided in Section E.1.a above.

In a further example, any of the MDI formulations provided herein in Section E.1.a can be prepared and stored in lyophilized form. Immediately prior to use under stress conditions, the lyophilized product can be diluted with stabilizing diluent containing lower pH (e.g. 6.5 to 7.8) and increased NaCl (120 mM to 200 mM) resulting in a CSII formulation with lower pH (e.g. 6.5 to 7.8) and increased NaCl (120 mM to 200 mM) than any of the MDI co-formulations provided in Section E.1.a above.

As shown in the examples herein, however, hyaluronan is not suitable for use with formulations stored at 2° C. to 8° C., since it causes insulin to aggregate at lower temperatures. Thus, in examples above where the CSII stable formulation is generated from dilution of an MDI formulation and the MDI co-formulation or modified concentrated MDI co-formulation does not contain a hyaluronidase inhibitor, a hyaluronidase inhibitor can be included in the stabilizing diluent in order to provide the appropriate concentration of hyaluronidase inhibitor to maintain stability of the co-formulation under stress conditions of elevated temperatures (e.g. 32° C. to 40° C.) for at least 3 days or agitation for at least 3 hours.

c. Exemplary Lys-Lys Co-Formulations

Provided herein are stable co-formulations that contain a therapeutically effective amount of a hyaluronan-degrading enzyme, such as a hyaluronidase for example a PH20 (e.g. rHuPH20), a therapeutically effective amount of a fast-acting insulin, such as a rapid-acting (e.g. fast-acting) insulin analog, and an amount of Lys-Lys to render the co-formulation stable. Typically, the co-formulations are multi-dose formulations and also contain a microbially effective amount of one or more preservatives. The co-formulations also can contain one or more other stabilizer or excipients. Such co-formulations are stable for at least 6 months at a temperature of from or from about 2° C. to or to about 8° C. and at least 14 days (i.e. 2 weeks) at a temperature of from or about 20° C. to or to about 30° C. In particular, such co-formulations are stable under accelerated conditions such as elevated temperatures greater than or about greater than 32° such as 35° C. to 40° C., in particular greater than at or about or 37° C. or 40° C. and/or agitation conditions for at least 3 days, The co-formulations can be used for multi-dose injection (MDI) use or for continuous subcutaneous insulin infusion (CSII) methods.

Exemplary stable Lys-Lys containing formulations are described below. The following stable formulations are exemplary only and provide a platform from which minor adjustments can be made. It is understood that very small changes in the concentrations of the various excipients and other components (e.g. ±15% of the stated concentrations), or small changes in pH, can be made while retaining some if not all of the insulin solubility and stability and hyaluronan degrading enzyme stability. Further changes also can be made by adding or removing excipients.

For example, co-formulations provided herein contain: 100 U/mL to 1000 U/mL of a hyaluronan-degrading enzyme such as a hyaluronidase for example a PH20 (e.g. rHuPH20), and in particular at or about or at least 600 U/mL; 10 U/mL to 1000 U/mL of a fast-acting insulin, and in particular at least or about 100 U/mL; the co-formulations further contain Lys-Lys at a concentration of between or about between 50 mM to 120 mM, such as 50 to 80 mM, 80 mM to 100 mM or 100 mM to 120 mM, a pH of between or about between 6.5 to 8.0, for example, 6.5 to 7.8 or 6.8 to 7.8 such as between or about between 6.5 to 7.5, 6.8 to 7.4 or 7.0 to 7.6, a buffering agent that maintains the pH range, an anti-microbially effective amount of a preservative or mixture of preservatives, and a stabilizing agent in an amount that, over the course of storage (temperature and time), retains at least 50% of the hyaluronan-degrading enzyme activity and retains at least 90% of the insulin purity, recovery and/or potency. For example, the co-formulations provided herein contain 0.0005% to 1.0% (e.g. 0.0005% to 0.005%) surfactant as a stabilizing agent. The co-formulations can optionally contain additional stabilizing agents, tonicity modifiers, an anti-oxidation agent and/or other excipients. For example, the co-formulations contain NaCl as a concentration of less than 140 mM, such as between or about between 0 mM to 100 mM, for example between or about between 0 mM to 50 mM, 10 mM to 40 mM or 20 mM to 30 mM.

In one example, an exemplary formulation contains: 100 U/mL to 1000 U/mL of a hyaluronan-degrading enzyme such as a hyaluronidase for example a PH20 (e.g. rHuPH20), and in particular at least or about at least or about 600 U/mL of a hyaluronan-degrading enzyme such as a hyaluronidase for example a PH20 (e.g. rHuPH20); 10 U/mL to 1000 U/mL of insulin glulisine, and in particular at least or about 100 U/mL from or from about 50 mM to or to about 105 mM Lys-Lys (e.g. at least or about at least 50 mM, 60 mM, 70 mM, 80 mM, 90 mM or 100 mM); 0 mM to or to about 50 mM methionine (e.g. between or about between 5 mM to 20 mM, such as at least or about at least 5 mM, 10 mM, 20 mM, 30 mM, 40 mM or 50 mM methionine); and from or from about 0.0005% to or to about 0.005% polysorbate 20, such as 0.001% to 0.005% (e.g. at least or about at least 0.0005%, 0.0001%, 0.005% or 0.001% polysorbate 20); and preservative(s) that include phenol at a percentage (%) of mass concentration (w/v) of between or between about between 0.01% to 0.25% and m-cresol at a % w/v of between or between about 0.05% to 0.2%. The formulations are prepared with a pH from or from about 6.8 to 7.4, (e.g. at least or about at least pH 6.8, 6.9, 7.0, 7.1, 7.2, 7.3 or 7.4). In further examples, NaCl is included at a concentration less than 140 mM. For example, NaCl is included in a concentration of less than 100 mM, such as at least or about at least 0 mM to 100 mM, for example at least or about at least 5 mM, 10 mM, 20 mM, 30 mM, 40 mM, 50 mM, 60 mM, 70 mM, 80 mM or 90 mM.

In another example, an exemplary formulation contains: 100 U/mL to 1000 U/mL of a hyaluronan-degrading enzyme such as a hyaluronidase for example a PH20 (e.g. rHuPH20), and in particular at least or about at least or about 600 U/mL of a hyaluronan-degrading enzyme such as a hyaluronidase for example a PH20 (e.g. rHuPH20); 10 U/mL to 1000 U/mL of insulin lispro or aspart, and in particular at least or about 100 U/mL from or from about 80 mM to or to about 100 mM Lys-Lys (e.g. at least or about at least 80 mM, 85 mM, 90 mM, 95 mM or 100 mM); 0 mM to or to about 50 mM methionine (e.g. between or about between 5 mM to 20 mM, such as at least or about at least 5 mM, 10 mM, 20 mM, 30 mM, 40 mM or 50 mM methionine); from or from about 0.0005% to or to about 0.005% polysorbate 20, such as 0.001% to 0.005% (e.g. at least or about at least 0.0005%, 0.0001%, 0.005% or 0.001% polysorbate 20); and preservative(s) that include phenol at a percentage (%) of mass concentration (w/v) of between or between about between 0.01% to 0.25% and m-cresol at a % w/v of between or between about 0.05% to 0.2% phenol. The formulations are prepared with a pH from or from about 6.8 to 7.4, (e.g. at least or about at least pH 6.8, 6.9, 7.0, 7.1, 7.2, 7.3 or 7.4). In further examples, NaCl is included at a concentration less than 140 mM. For example, NaCl is included in a concentration of less than 100 mM, such as at least or about at least 0 mM to 100 mM, for example at least or about at least 5 mM, 10 mM, 20 mM, 30 mM, 40 mM, 50 mM, 60 mM, 70 mM, 80 mM or 90 mM.

G. DOSAGE AND ADMINISTRATION

The compositions provided herein that are stable formulations of a hyaluronan-degrading enzyme can be formulated as pharmaceutical compositions for single or multiple dosage administration. The co-formulations of a hyaluronan degrading enzyme and a fast-acting insulin are formulated as pharmaceutical compositions for multiple dosage administration. The formulations and co-formulations can be formulated by any suitable route, such as, for example, parenteral administration, including subcutaneous, intramuscular, intraperitoneal, intravenous, and intradermal administration. Typically, the formulations or co-formulations provided herein are administered subcutaneously.

Therapeutically effective doses can be determined empirically by testing the formulations or co-formulations in known in vitro and in vivo systems and also can be individualized for each subject based upon such factors as metabolism, food intake and severity of the disease. The concentration of a hyaluronan-degrading enzyme and/or selected insulin in the formulation or co-formulation depends on, for example, absorption, inactivation and excretion rates of the complex, the physicochemical characteristics of the complex, the dosage schedule, and amount administered as well as other factors known to those of skill in the art. For example, for co-formulations with insulin, it is understood that the precise dosage of treatment is a function of the blood glucose levels in a subject, and can be determined empirically using known algorithms or by extrapolation from in vivo or in vitro test data, past experience of the subject, carbohydrate counting to determine the carbohydrate content in a meal and, therefore, the estimated prandial blood glucose increase and subsequent requirement for insulin. It is to be noted that concentrations and dosage values can vary with each subject treated. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. The amount of a selected insulin to be administered for the treatment of a diabetic condition can be determined by standard clinical techniques. In addition, in vitro assays and animal models can be employed to help identify optimal dosage ranges.

Hence, the precise dosage, which can be determined empirically, can depend on the particular hyaluronan-degrading enzyme and/or insulin contained in the formulations or co-formulations, the regime and dosing schedule, the route of administration, the type of diabetes to be treated, the seriousness of the disease and the subject being treated. Generally, insulin is provided in an amount that achieves glycemic control. For example, to achieve post prandial glycemic control, diabetic subjects typically are administered a bolus injection of or about 0.05 U of fast-acting insulin per kg body weight (U/kg) to 1.0 U/kg 30 minutes to 5 minutes prior to a meal, when insulin is delivered without a hyaluronan degrading enzyme. It is understood that this dose can be increased or decreased as appropriate based upon, for example, the metabolism of a particular subject, the content of the meal, and blood glucose levels. It is further understood that the time at which the insulin is delivered for post prandial glycemic control can be changed to be closer to or further from the time of ingestion of a meal, and, in some cases, can be changed such that the insulin is delivered at the time of the meal or after the meal.

Fast-acting insulins typically are administered at doses of between 0.05 Units/kg to 0.25 Units/kg, such as, for example, 0.10 Units/kg, although the particular dose varies. Due to the improved pharmacokinetic and pharmacodynamic properties of insulin co-formulated with hyaluronan degrading enzymes (such as rHuPH20), the provide co-formulations can be administered at lower doses compared to the fast-acting insulin administered in the absence of a hyaluronan degrading enzyme. The degree to which the amount of a fast-acting insulin can be lowered by administering it as a co-formulation with a hyaluronan degrading enzyme depends on, for example, the type of diabetes the patient has and the type of insulin contained in the co-formulation. Typically, the reduction in the amount of fast-acting insulin administered to Type 2 diabetic patients when administered as co-formulation with hyaluronan degrading enzyme is greater than the reduction in the amount of fast-acting insulin administered to Type 1 diabetic patients when administered as a co-formulation with a hyaluronan degrading enzyme. For example, in instances where a Type 1 diabetic patient and Type 2 diabetic patient are both administered 0.20 U/kg of fast-acting insulin to control postprandial glucose levels, the Type 1 diabetic patient can be administered 0.15 U/kg of fast-acting insulin co-formulated with a hyaluronan degrading enzyme to achieve the same or better glycemic control, and the Type 2 diabetic patient can be administered 0.10 U/kg fast-acting insulin co-formulated with a hyaluronan degrading enzyme to achieve the same or better glycemic control.

Exemplary dosage ranges for parenteral, such as subcutaneous, administration of insulin using the co-formulations with a hyaluronan degrading enzyme provided herein to control postprandial blood glucose levels are from at or about 0.05 U/kg to 0.50 U/kg, such as 0.05 U/kg, 0.06 U/kg, 0.07 U/kg, 0.08 U/kg, 0.09 U/kg, 0.10 U/kg, 0.11 U/kg, 0.12 U/kg, 0.13 U/kg, 0.14 U/kg, 0.15 U/kg, 0.20 U/kg, 0.25 U/kg, 0.30 U/kg, 0.40 U/kg, 0.50 U/kg or 1.0 U/kg. The particular dosage depends upon the disease and individual.

The co-formulations of insulin and a hyaluronan degrading enzyme provided herein also can be administered to diabetic subjects to effect glycemic control throughout the day and night, in addition to postprandial glycemic control. Typically, dosages of insulin administered to provide continuous glycemic control are less than those required to achieve postprandial glycemic control. Dosages can, however, be increased or decreased based on blood glucose levels. Exemplary dosage ranges for parenteral, such as subcutaneous, administration of insulin administered as a co-formulation with a hyaluronan degrading enzyme to provide continuous glycemic control are from at or about 0.001 U/kg to 0.30 U/kg, such as 0.001 U/kg, 0.005 U/kg, 0.01 U/kg, 0.02 U/kg, 0.05 U/kg to 0.30 U/kg, such as 0.05 U/kg, 0.06 U/kg, 0.07 U/kg, 0.08 U/kg, 0.09 U/kg, 0.10 U/kg, 0.11 U/kg, 0.12 U/kg, 0.13 U/kg, 0.14 U/kg, 0.15 U/kg, 0.20 U/kg, 0.25 U/kg, 0.30 U/kg, 0.40 U/kg, 0.50 U/kg or 1.0 U/kg. The particular dosage depends upon the disease, the time of administration, and the individual. If necessary, dosage can be empirically determined.

It is understood that the precise dosage and duration of treatment is a function of the diabetes being treated and can be determined empirically using known testing protocols or by extrapolation from in vivo or in vitro test data. It is to be noted that dosage values also can vary with the severity of the diabetes and other factors, such as metabolism, food intake, and body weight of the subject. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered every minute, every several minutes, hourly, daily, weekly, monthly, yearly or once, depending upon the subject and the diabetic state. Generally, dosage regimens are chosen to limit toxicity and/or other negative effects, such as excess insulin. It should be noted that the attending physician would know how to and when to terminate, interrupt or adjust therapy to lower dosage. Conversely, the attending physician would also know how to and when to adjust treatment to higher levels if the clinical response is not adequate (precluding toxic side effects).

Mode of Administration a. Syringes or Vials

The formulations or co-formulations provided herein can be parentally administered to a subject using one or more of several modes of administration, including, but not limited to, syringes, vials or other containers suitable for single dose or multiple dose formulations. For example, single-use syringes, including insulin syringes, can be used to administer discrete injections, e.g. bolus injections, of the compositions. Syringes useful for administrations of the compositions provided herein include insulin syringes, which can be designed to hold standard concentrations of insulin preparations, including 100 U/ml concentrations of insulin preparations, and have markings in insulin units for ease of administration.

b. Insulin Pen

An insulin pen is a delivery system that can be used to administer the co-formulations provided herein. Insulin pens include those with replaceable cartridges filled with the composition to be administered and those with non-replaceable cartridges. Insulin pens with non-replaceable cartridges are typically disposed of when the cartridge has been emptied. Insulin pens enable dosing in, for example, half unit, one unit or two unit increments, which are generally measured using a dosing dial or other mechanism to set the dose (see e.g. U.S. Pat. Nos. 5,947,934, 6,074,372, 6,110, 149, 6,524,280, 6,582,404). The co-formulation is then delivered by way of a fine needle attached to the pen. Insulin pens are well known in the art and include those described elsewhere, including, but not limited to, those described in U.S. Pat. Nos. 5,947,934, 4,973,318, 5,462,535, 5,599,323, 5,626,566, 5,984,906, 6,074,372, 6,110,149, 6,302,869, 6,379,339 and 7,241,278). Other similar dosing devices, such as for example, those described in U.S. Pat. Nos. 5,947,934, 6,074,372, 6,110,149 and 6,379,339 also can be used to administer the compositions provided herein, either as a co-formulation of insulin and hyaluronan degrading enzyme or separately as an insulin composition and a hyaluronan degrading enzyme composition. In some examples, the insulin pen or similar device also contains a sensor or monitor that than can measure the blood glucose level of the subject (see e.g. WO2003047426).

Insulin pens and similar delivery devices that can be used, or modified to be used, to deliver the co-formulations provided herein are well known in the art and include, but are not limited to, those marketed under the trademarks Autopen® (Owen Mumford, Inc.), Disetronic Pen (Disetronic Medical Systems), Humalog® Pen (Eli Lilly and Company), Humalog® Mix 75/25 Pen (Eli Lilly and Company), Humulin® 70/30 Pen (Eli Lilly and Company), Humulin® N Pen (Eli Lilly and Company), Novolog® FlexPen (Novo Nordisk), NovoPen® 3 (Novo Nordisk), NovoPen® 4 (Novo Nordisk), NovoPen® Junior (Novo Nordisk), Novolog® Mix 70/30 FlexPen (Novo Nordisk), InDuo® (Novo Nordisk), Novolin® InnoLet® (Novo Nordisk), Innovo® (Novo Nordisk), OptiPen® (Sanofi-Aventis) OptiPen® Pro2 (Sanofi-Aventis), OptiSet® (Sanofi-Aventis) and SoloSTAR® (Sanofi-Aventis).

c. Insulin Pumps and Other Insulin Delivery Devices

The co-formulations provided herein can be administered to a diabetic subject using an insulin delivery device, such as an insulin pump or other similar continuous infusion device. Insulin delivery devices typically contain at least one disposable reservoir containing an insulin formulation, a pump (including any controls, software, processing modules and/or batteries) and a disposable infusion set, including a cannula or needle for subcutaneous injection and a tube connecting the cannula or needle to the insulin reservoir. For use with the stable co-formulations provided herein, the insulin delivery device can contain a reservoir containing the co-formulated insulin and hyaluronan degrading enzyme. The co-formulations can be administered continuously or in bolus injections. Further, an insulin delivery device user has the ability to influence the profile of the insulin by shaping the bolus. For example, a standard bolus can be administered, which is an infusion similar to a discrete injection in that all of the dose is pumped immediately. An extended bolus is a slow infusion over time that avoids a high initial dose and extends the action of the composition. A combination bolus containing both a standard bolus and an extended bolus also can be administered using an insulin pump or other continuous delivery system. Insulin delivery devices are known in the art and described elsewhere, including, but not limited to, in U.S. Pat. Nos. 6,554,798, 6,641,533, 6,744,350, 6,852,104, 6,872,200, 6,936,029, 6,979,326, 6,999,854, 7,025,713 and 7,109,878. Insulin delivery devices also can be connected to a glucose monitor or sensor, and/or can contain a means to calculate the recommended insulin dose based upon blood glucose levels, carbohydrate content of a meal, or other input. Further insulin delivery devices can be implantable or can be external to the subject.

d. Continuous Infusion Pump Systems

An insulin delivery device for use with the co-formulations herein includes an insulin pump or other similar device capable of continuous subcutaneous insulin infusion. Insulin delivery devices, including open loop and closed loop systems, typically contain at least one disposable reservoir containing an insulin co-formulation, a pump (including any controls, software, processing modules and/or batteries) and a disposable infusion set, including a cannula or needle for subcutaneous injection and a tube connecting the cannula or needle to the insulin reservoir. Closed loop delivery devices additionally include a glucose monitor or sensor. The insulin delivery device can contain a reservoir containing a superfast acting insulin co-formulation of insulin and a hyaluronan degrading enzyme.

The insulin co-formulations can be administered continuously and/or in bolus injections. Users set the pump to give a steady trickle or "basal" amount of insulin formulation continuously throughout the day. Pumps also release additional ("bolus") doses of insulin formulation at meals and at times when blood sugar is too high based on user input.

Frequent blood glucose monitoring is essential to determine insulin dosages and to ensure that insulin is delivered appropriately. This can be achieved by manual monitoring, or by a separate or contained glucose monitor. Further, an insulin delivery device user has the ability to influence the profile of the insulin by shaping the bolus. For example, a standard bolus can be administered, which is an infusion similar to a discrete injection in that all of the dose is pumped immediately. An extended bolus is a slow infusion over time that avoids a high initial dose and extends the action of the composition. A combination bolus containing both a standard bolus and an extended bolus also can be administered using an insulin pump or other continuous delivery system.

Insulin delivery devices are known in the art and described elsewhere, including, but not limited to, in U.S. Pat. Nos. 6,554,798, 6,641,533, 6,744,350, 6,852,104, 6,872,200, 6,936,029, 6,979,326, 6,999,854, 7,025,713 and 7,109,878. Insulin delivery devices also can be connected to a glucose monitor or sensor, e.g., a closed-loop system, and/or can contain a means to calculate the recommended insulin dose based upon blood glucose levels, carbohydrate content of a meal, or other input. Further insulin delivery devices can be implantable or can be external to the subject. The use of external insulin infusion pumps requires careful selection of individuals, meticulous monitoring, and thorough education and long term ongoing follow-up. This care is generally provided by a multidisciplinary team of health professionals with specific expertise and experience in the management of individuals on insulin pump treatment.

i. Open Loop Systems

Open loop systems can be used with the co-formulations provided herein. Open loop systems typically contain at least one disposable reservoir containing an insulin formulation, a pump (including any controls, software, processing modules and/or batteries) and a disposable infusion set, including a cannula or needle for subcutaneous injection and a tube connecting the cannula or needle to the insulin reservoir. The open loop system infuses in small (basal) doses every few minutes and large (bolus) doses that the patient sets manually. But, an open loop system does not generally contain a glucose monitor or sensor and therefore cannot respond to changes in the patient's serum glucose levels. Various methods and devices used to measure blood glucose levels are known to one of skill in the art. The conventional technique used by many diabetics for personally monitoring their blood glucose level includes the periodic drawing of blood, the application of that blood to a test strip, and the determination of the blood glucose level using calorimetric, electrochemical, or photometric detection. A variety of devices have been developed for continuous or automatic monitoring of analytes, such as glucose, in the blood stream or interstitial fluid. Some of these devices use electrochemical sensors which are directly implanted into a blood vessel or in the subcutaneous tissue of a patient. Exemplary methods and devices for monitoring glucose levels include, but are not limited to, those described in U.S. Pat. Nos. 5,001,054, 5,009,230, 5,713,353, 6,560,417, 6,574,490, 6,892,085, 6,958,809, 7,299,081, 7,774,145, 7,826,879, 7,857,760 and 7,885,699, which are incorporated herein by reference.

Insulin delivery systems, such as insulin pumps, are known in the art and can be used in the open loop systems. Exemplary open loop insulin delivery devices (such as those described above) include, but are not limited to, those described in U.S. Pat. Nos. 4,562,751, 4,678,408, 4,685,903, 4,373,527, 4,573,994, 6,554,798, 6,641,533, 6,744,350, 6,852,104, 6,872,200, 6,936,029, 6,979,326, 6,999,854, 7,109,878, 7,938,797 and 7,959,598, which are incorporated by reference herein. These and similar systems, easily identifiable by one of skill in the art, can be used to deliver the co-formulations provided herein. The insulin delivery devices typically contain one or more reservoirs, which generally are disposable, containing an insulin preparation, such as a co-formulation of a fast acting insulin and hyaluronan degrading enzyme described herein. In some examples, the co-formulations are delivered using an infusion tube and a cannula or needle. In other examples, the infusion device is attached directly to the skin and the co-formulations flow from the infusion device, through a cannula or needle directly into the body without the use of a tube. In further examples, the infusion device is internal to the body and an infusion tube optionally can be used to deliver the co-formulations.

ii. Closed Loop Systems

Closed loop systems, sometimes referred to as an artificial pancreas, are of particular interest for use with the co-formulations provided herein. Closed loop systems refer to systems with an integrated continuous glucose monitor, an insulin pump or other delivery system and controller that includes a mathematical algorithm that constantly calculates the required insulin infusion for glycemic control based upon real time measurements of blood glucose levels. Such systems, when optimized, can facilitate constant and very tight glycemic control, similar to the natural insulin response and glycemic control observed in a healthy non-diabetic subject. To be effective, however, closed loop systems require both a reliable and accurate continuous glucose monitor, and delivery of an insulin with a very fast action. For example, delays in insulin absorption and action associated with subcutaneous delivery of fast-acting insulins can lead to large postprandial glycemic excursions (Hovorka et al. (2006) *Diabetic Med.* 23:1-12). The delay because of insulin absorption, insulin action, interstitial glucose kinetics, and the transport time for ex vivo-based monitoring systems, such as those based on the microdialysis technique, can result in an overall 100 minute or more time lag from the time of insulin delivery to the peak of its detectable glucose-lowering effect (Hovorka et al. (2006) *Diabetic Med.* 23:1-12). Thus, once administered, insulin will continue to increase its measurable effect for nearly 2 hours. This can complicate effective lowering of glucose concentration following meal ingestion using a closed-loop system. First, a glucose increase has to be detected. However, this typically happens only after an approximate 10-40 minute lag. The system must determine that a meal has been digested and administer an appropriate insulin dose. The ability of the system to compensate subsequently for a 'misjudged' insulin dose is compromised by long delays and the inability to 'withdraw' insulin once administered. Such problems can, at least in part, be overcome by using the co-formulations of a fast-acting insulin and hyaluronan degrading enzyme, such as those provided herein, which can exhibit an increased rate and level of absorption and an associated improvement in the pharmacodynamics (see e.g. US20090304665 and WO2009134380). Co-formulations of fast-acting insulin and a hyaluronan degrading enzyme have a reduced $t_{max}$ (i.e. achieve maximal concentration faster) than fast-acting insulins alone and begin controlling blood glucose levels faster than fast-acting insulins alone. This increased rate of absorbance and onset of action reduces the lag between insulin action and glucose monitoring and input, resulting in a more effective closed loop system that can more tightly control blood glucose levels, reducing glycemic excursions.

Closed loop systems are well known in the art and have been described elsewhere, including, but not limited to, U.S. Pat. Nos. 5,279,543, 5,569,186, 6,558,351, 6,558,345, 6,589,229, 6,669,663, 6,740,072, 7,267,665 and 7,354,420, which are incorporated by reference herein. These and similar systems, easily identifiable by one of skill in the art, can be used to deliver the co-formulations provided herein. Closed loops systems include a sensor system to measure blood glucose levels, a controller and a delivery system. This integrated system is designed to model a pancreatic beta cell (β-cell), such that it controls an infusion device to deliver insulin into a subject in a similar concentration profile as would be created by fully functioning human β-cells when responding to changes in blood glucose concentrations in the body. Thus, the system simulates the body's natural insulin response to blood glucose levels and not only makes efficient use of insulin, but also accounts for other bodily functions as well since insulin has both metabolic and mitogenic effects. Further, the glycemic control achieved using a closed loop system is achieved without requiring any information about the size and timing of a meal, or other factors. The system can rely solely on real time blood glucose measurements. The glucose sensor generates a sensor signal representative of blood glucose levels in the body, and provides the sensor signal to the controller. The controller receives the sensor signal and generates commands that are communicated to the insulin delivery system. The insulin delivery system receives the commands and infuses insulin into the body in response to the commands. Provided below are descriptions of exemplary components of closed loop systems that can be used to deliver the co-formulations of a fast acting insulin and a hyaluronan degrading enzyme provided herein. It is understood that one of skill in the art can readily identify suitable closed loop systems for use with the co-formulations. Such systems have been described in the art, including but not limited to, those described in U.S. Pat. Nos. 5,279,543, 5,569,186, 6,558,351, 6,558,345, 6,589,229, 6,669,663, 6,740,072, 7,267,665 and 7,354,420. The individual components of the systems also have been described in the art, individually and in the context of a closed loops system for use in achieving glycemic control. It is understood that the examples provided herein are exemplary only, and that other closed loop systems or individual components can be used to deliver the co-formulations provided herein.

Closed loop systems contain a glucose sensor or monitor that functions continuously. Such devices can contain needle-type sensors that are inserted under the skin and attached to a small transmitter that communicates glucose data wirelessly by radiofrequency telemetry to a small receiver. In some examples, the sensor is inserted through the subject's skin using an insertion needle, which is removed and disposed of once the sensor is positioned in the subcutaneous tissue. The insertion needle has a sharpened tip and an open slot to hold the sensor during insertion into the skin (see e.g. U.S. Pat. Nos. 5,586,553 and 5,954,643). The sensor used in the closed loop system can optionally contain three electrodes that are exposed to the interstitial fluid (ISF) in the subcutaneous tissue. The three electrodes include a working electrode, a reference electrode and a counter electrode that are used to form a circuit. When an appropriate voltage is supplied across the working electrode and the reference electrode, the ISF provides impedance between the electrodes. An analog current signal flows from the working electrode through the body and to the counter electrode. The voltage at the working electrode is generally held to ground, and the voltage at the reference electrode can be held at a set voltage Vset, such as, for example, between 300 and 700 mV. The most prominent reaction stimulated by the voltage difference between the electrodes is the reduction of glucose as it first reacts with the glucose oxidase enzyme (GOX) to generate gluconic acid and hydrogen peroxide ($H_2O_2$). Then the $H_2O_2$ is reduced to water ($H_2O$) and ($O^-$) at the surface of the working electrode. The $O^-$ draws a positive charge from the sensor electrical components, thus repelling an electron and causing an electrical current flow. This results in the analog current signal being proportional to the concentration of glucose in the ISF that is in contact with the sensor electrodes (see e.g. U.S. Pat. No. 7,354,420).

In some examples, more than one sensor is used to measure blood glucose. For example, redundant sensors can be used and the subject can be notified when a sensor fails by the telemetered characteristic monitor transmitter electronics. An indicator also can inform the subject of which sensors are still functioning and/or the number of sensors still functioning. In other examples, sensor signals are combined through averaging or other means. Further, different types of sensors can be used. For example, an internal glucose sensor and an external glucose sensor can be used to measure blood glucose at the same time.

Glucose sensors that can be used in a closed loop system are well known and can be readily identified and, optionally, further modified, by one of skill in the art. Exemplary internal glucose sensors include, but are not limited to, those described in U.S. Pat. Nos. 5,497,772, 5,660,163, 5,791,344, 5,569,186 and 6,895,265. Exemplary of a glucose sensor that uses florescence is that described in U.S. Pat. No. 6,011,984. Glucose sensor systems also can use other sensing technologies, including light beams, conductivity, jet sampling, micro dialysis, micro-poration, ultra sonic sampling, reverse iontophoresis, or other method (e.g. U.S. Pat. Nos. 5,433,197 and 5,945,676, and International Pat. Pub. WO 199929230). In some examples, only the working electrode is located in the subcutaneous tissue and in contact with the ISF, and the counter and reference electrodes are located external to the body and in contact with the skin. The counter electrode and the reference electrode can be located on the surface of a monitor housing and can be held to the skin as part of a telemetered characteristic monitor. In further examples, the counter electrode and the reference electrode are held to the skin using other devices, such as running a wire to the electrodes and taping the electrodes to the skin, incorporating the electrodes on the underside of a watch touching the skin. Still further, more than one working electrode can be placed into the subcutaneous tissue for redundancy. Interstitial fluid also can be harvested from the body of a subject and flowed over an external sensor that is not implanted in the body.

The controller receives input from the glucose sensor. The controller is designed to model a pancreatic beta cell (β-cell) and provide commands to the insulin delivery device to infuse the required amount of insulin for glycemic control. The controller utilizes software with algorithms to calculate the required amount of insulin based upon the glucose levels detected by the glucose sensor. Exemplary algorithms include those that model the β-cells closely, since algorithms that are designed to minimize glucose excursions in the body, without regard for how much insulin is delivered, can cause excessive weight gain, hypertension, and atherosclerosis. Typically, the system is intended to emulate the in vivo insulin secretion pattern and to adjust this pattern consistent with the in vivo β-cell adaptation experienced by normal healthy individuals. Control algorithms useful for closed loop systems include those utilized by a proportional-integral-derivative (PID) controller. Proportional derivative controllers and model predictive control (MPC) algorithms also can be used in some systems (Hovorka et al. (2006) *Diabetic Med.* 23:1-12). Exemplary algorithms include, but are not limited to, those described Hovorka et al. (*Diabetic Med.* (2006) 23:1-12), Shimoda et al., (*Front Med Biol Eng* (1997) 8:197-211), Shichiri et al. (*Artif: Organs* (1998) 22:32-42), Steil et al. (*Diabetes Technol Ther* (2003) 5: 953-964), Kalatz et al., (*Acta Diabetol.* (1999) 36:215) and U.S. Pat. Nos. 5,279,543, 5,569,186, 6,558,351, 6,558,345, 6,589,229, 6,740,042, 6,669,663, 6,740,072, 7,267,665 and 7,354,420 and U.S. Pat. Pub. No. 20070243567.

In one example, a PID controller is utilized in the closed loop system. A PID controller continuously adjusts the insulin infusion by assessing glucose excursions from three viewpoints: the departure from the target glucose (the proportional component), the area under the curve between ambient and target glucose (the integral component), and the change in ambient glucose (the derivative component). Generally, the in vivo β-cell response to changes in glucose is characterized by "first" and "second" phase insulin responses. The biphasic insulin response of a β-cell can be modeled using components of a proportional, plus integral, plus derivative (PID) controller (see e.g. U.S. Pat. No. 7,354,420).

The controller generates commands for the desired insulin delivery. Insulin delivery systems, such as insulin pumps, are known in the art and can be used in the closed loop systems. Exemplary insulin delivery devices (such as those described above) include, but are not limited to, those described in U.S. Pat. Nos. 4,562,751, 4,678,408, 4,685,903, 4,373,527, 4,573,994, 6,554,798, 6,641,533, 6,744,350, 6,852,104, 6,872,200, 6,936,029, 6,979,326, 6,999,854, 7,025,713 and 7,109,878. The insulin delivery devices typically contain one or more reservoirs, which generally are disposable, containing an insulin preparation, such as a co-formulation of a fast acting insulin and hyaluronan degrading enzyme described herein. In some examples, the co-formulations are delivered using an infusion tube and a cannula or needle. In other examples, the infusion device is attached directly to the skin and the co-formulations flow from the infusion device, through a cannula or needle directly into the body without the use of a tube. In further examples, the infusion device is internal to the body and an infusion tube optionally can be used to deliver the co-formulations. Closed loop systems also can contain additional components, including, but not limited to, filters, calibrators and transmitters.

H. METHODS OF PRODUCING NUCLEIC ACIDS ENCODING AN INSULIN OR HYALURONAN DEGRADING ENZYME AND POLYPEPTIDES THEREOF

Polypeptides of an insulin and hyaluronan degrading enzyme set forth herein can be obtained by methods well known in the art for protein purification and recombinant protein expression. Polypeptides also can be synthesized chemically. For example, the A-chain and B-chain of insulin can be chemically synthesized and then cross-linked by disulfide bonds through, for example, a reduction-reoxidation reaction. When the polypeptides are produced by recombinant means, any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant insulins or hyaluronan degrading enzymes can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), and samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

Insulin can be produced using a variety of techniques (see e.g. Ladisch et al. (1992) *Biotechnol. Prog.* 8:469-478). In some examples, nucleic acid encoding a preproinsulin or proinsulin polypeptide is inserted into an expression vector. Upon expression, the preproinsulin or proinsulin polypeptide is converted to insulin by enzymatic or chemical methods that cleave the signal sequence and/or the C peptide, resulting in the A- and B-chains that are cross-linked by disulfide bonds through, for example, a reduction-reoxidation reaction (see e.g. Cousens et al., (1987) *Gene* 61:265-275, Chance et al., (1993) *Diabetes Care* 4:147-154). In another example, the nucleic acid encoding the A-chain and B-chain of an insulin are inserted into one or two expression vectors for co-expression as a single polypeptide from one expression vector or expression as two polypeptides from one or two expression vectors. Thus, the A- and B-chain polypeptides can be expressed separately and then combined to generate an insulin, or can be co-expressed, in the absence of a C chain. In instances where the A- and B-chains are co-expressed as a single polypeptide, the nucleic acid encoding the subunits also can encode a linker or spacer between the B-chain and A-chain, such as a linker or spacer described below. The nucleic acid inserted into the expression vector can contain, for example, nucleic acid encoding the insulin B-chain, a linker, such as for example, an alanine-alanine-lysine linker, and the A-chain, resulting in expression of, for example, "insulin B chain-Ala-Ala-Lys-insulin A chain."

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the soluble hyaluronidase polypeptide coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242: 74-94(1980); plant expression vectors containing the nopaline synthetase promoter (Herrera-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Linker Moieties

In some examples, insulin is prepared by generating the A-chain and B-chain polypeptides with a linker, such that, for example, the C-terminus of the B-chain is joined to the N-terminus of the A-chain by a short linker. The A-chain and B-chains can be expressed from a single polypeptide containing a linker, or can be expressed separately and then joined by a linker. The linker moiety is selected depending upon the properties desired. The linker moiety should be long enough and flexible enough to allow the A-chain and B-chain to mimic the natural conformation of the insulin.

Linkers can be any moiety suitable to the insulin A-chain and B-chain. Such moieties include, but are not limited to, peptidic linkages; amino acid and peptide linkages, typically containing between one and about 60 amino acids; chemical linkers, such as heterobifunctional cleavable cross-linkers, photocleavable linkers and acid cleavable linkers.

The linker moieties can be peptides. The peptide linker typically has from about 2 to about 60 amino acid residues, for example from about 5 to about 40, or from about 10 to about 30 amino acid residues. Peptidic linkers can conveniently be encoded by nucleic acid and incorporated in fusion proteins upon expression in a host cell, such as *E. coli*. In one example, an alanine-alanine-lysine (AAK) (SEQ ID NO:178) linker is encoded in a nucleic acid between nucleic acid encoding the insulin B-chain and nucleic acid encoding the A-chain, such that upon expression, an "insulin B-chain-AAK-insulin A chain" polypeptide is produced. Peptide linkers can be a flexible spacer amino acid sequence, such as those known in single-chain antibody research. Examples of such known linker moieties include, but are not limited to, RPPPPC (SEQ ID NO:166) or SSPPPPC (SEQ ID NO:167), GGGGS (SEQ ID NO:168), (GGGGS)$_n$ (SEQ ID NO:169), GKSSGSGSESKS (SEQ ID NO:170), GST-SGSGKSSEGKG (SEQ ID NO:171), GSTSGS-GKSSEGSGSTKG (SEQ ID NO:172), GSTSGS-GKSSEGKG (SEQ ID NO:173), GSTSGSGKPGSGEGSTKG (SEQ ID NO:174), EGKSSGSGSESKEF (SEQ ID NO:175), SRSSG (SEQ ID NO:176) and SGSSC (SEQ ID NO:177).

Alternatively, the peptide linker moiety can be VM (SEQ ID NO: 179) or AM (SEQ ID NO: 180), or have the structure described by the formula: AM(G$_{2\ to\ 4}$S)$_x$AM wherein X is an integer from 1 to 11 (SEQ ID NO: 181). Additional linking moieties are described, for example, in Huston et al. (1988) *Proc. Natl. Acad. Sci. U.S.A.* 85:5879-5883; Whitlow, M., et al. (1993) *Protein Engineering* 6:989-995; Newton et al. (1996) *Biochemistry* 35:545-553; A. J. Cumber et al. (1992) *Bioconj. Chem.* 3:397-401; Ladurner et al., (1997) *J. Mol. Biol.* 273:330-337; and U.S. Pat. No. 4,894,443.

In some examples, peptide linkers are encoded by nucleic acid and incorporated between the B-chain and A-chain upon expression in a host cell, such as *E. coli* or *S. cerevisiae*. In other examples, a peptide linker is synthesized by chemical methods. This can be performed in a separate protocol to the synthesis of one or more of the A- and B-chain, after which the components are joined, such as with the use of heterobifunctional linkers. Alternatively, a peptide linker can be synthesized at the N- or C-terminus of one of the insulin chains, which is then linked to the other chain via the peptide linker, such as with a heterobifunctional linker.

Any linker known to those of skill in the art can be used herein to link the insulin A-chain and B-chain. Linkers and linkages that are suitable for chemically linking the chains include, but are not limited to, disulfide bonds, thioether bonds, hindered disulfide bonds, and covalent bonds between free reactive groups, such as amine and thiol groups. These bonds are produced using heterobifunctional reagents to produce reactive thiol groups on one or both of the polypeptides and then reacting the thiol groups on one polypeptide with reactive thiol groups or amine groups to which reactive maleimido groups or thiol groups can be attached on the other. Other linkers include, acid cleavable linkers, such as bismaleimideothoxy propane, acid labile-transferrin conjugates and adipic acid dihydrazide, that would be cleaved in more acidic intracellular compartments; cross linkers that are cleaved upon exposure to UV or visible light and linkers, such as the various domains, such as CH1, CH2, and CH3, from the constant region of human IgG1 (see, Batra et al. (1993) *Molecular Immunol.* 30:379-386). In some embodiments, several linkers can be included in order to take advantage of desired properties of each linker. Chemical linkers and peptide linkers can be inserted by covalently coupling the linker to the insulin A-chain and B-chain. The heterobifunctional agents, described below, can be used to effect such covalent coupling. Peptide linkers also can be linked by expressing DNA encoding the linker between the B-chain and A-chain.

Other linkers that can be used to join the A-chain and B-chain of insulin include: enzyme substrates, such as cathepsin B substrate, cathepsin D substrate, trypsin substrate, thrombin substrate, subtilisin substrate, Factor Xa substrate, and enterokinase substrate; linkers that increase solubility, flexibility, and/or intracellular cleavability include linkers, such as $(gly_m ser)_n$ and $(ser_m gly)_n$, in which m is 1 to 6, preferably 1 to 4, more preferably 2 to 4, and n is 1 to 30, preferably 1 to 10, more preferably 1 to 4 (see, e.g., International PCT application No. WO 96/06641, which provides exemplary linkers). In some embodiments, several linkers can be included in order to take advantage of desired properties of each linker.

3. Expression

Insulin and hyaluronan degrading enzyme polypeptides can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Soluble hyaluronidase polypeptides also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce a glycosylated proteins. Thus, if proteins require glycosylation for function, glycosylation can be added in vitro after purification from host cells.

b. Yeast Cells

Yeasts such as *Saccharomyces cerevisiae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ξ and Fc$_e$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen, Carlsbad, Calif., cat #11619-012) and the serum free EBNA-1 cell line (Pham et al., (2003) *Biotechnol. Bioeng.* 84:332-42.). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with agrobacterium-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

4. Purification Techniques

Method for purification of polypeptides, including insulin and hyaluronan degrading enzyme polypeptides or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as insulin polypeptides or hyaluronan degrading enzyme polypeptides, can be purified using standard protein purification techniques known in the art including but not limited to, SDS-PAGE, size fractionation and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or $His_6$ and affinity purified with myc antibody, glutathione resin and Ni-resin, respectively. Purity can be assessed by any method known in the art including gel electrophoresis, orthogonal HPLC methods, staining and spectrophotometric techniques.

I. METHODS OF ASSESSING STABILITY AND ACTIVITY

Assays can be used to assess the stability of the formulations or co-formulations provided herein, including co-formulations containing a fast-acting insulin and hyaluronan degrading enzyme provided herein. Such assays can assess the stability and activity of the hyaluronan degrading enzyme and/or the stability, activity and solubility of the fast-acting insulin in the co-formulations. Such assays can be used, for example, to determine the stability of the co-formulations over time at particular storage temperatures and conditions, by assessing activity, solubility, and stability (e.g. formation of aggregates, etc.) prior to storage and then at various time points thereafter. The assays also can be used make minor adjustments to the formulations provided herein while retaining the stability of both active agents.

1. Insulin

The stability and solubility of the insulin co-formulations provided herein can be assessed using methods and assays well known in the art. For example, insulin stability and solubility can be assessed by visual assessment, acid clarification, optical microscopy, reversed phase high performance liquid chromatography (RP-HPLC), in vivo bioassays and denaturing and non-denaturing size exclusion chromatography (SEC). In one example, insulin solubility and stability is determined by visual assessment, including changes in color, clarity, presence of aggregates or clumping and material adhesion, or frosting, to the vessel containing the co-formulations provided herein. Visual changes are confirmed by acid clarification, wherein lack of dissolution after acidification confirms the presence of insoluble denatured insulin in the co-formulations provided herein. Visual changes in the insulin in the co-formulations provided herein can also be confirmed by optical microscopy and/or micrography by fluorescent backlighting. The apparent solubility of a fast acting insulin in the co-formulations provided herein can be assessed, for example, by RP-HPLC, such as described in Example 3. In the methods sets forth in Example 3, apparent solubility is measured as the percent insulin recovery following storage under various conditions and time points. Percent recovery is determined as compared to a reference sample. In addition, insulin degradation products, such as desamido insulin, can be determined by RP-HPLC. In one example, insulin stability in the co-formulations provided herein is assessed by measuring the formation of aggregates using size exclusion chromatography (see e.g., Example 4). In this example, SEC is used to determine the presence of high molecular weight proteins, i.e., aggregates.

Insulin activity also can be assessed using methods and assays well known in the art. For example, the ability of an insulin, including insulin compositions and co-formulations, to act as a therapeutic agent can be assessed in vitro or in vivo. For example, in vitro assays well known in the art can be performed to assess the ability of an insulin to bind to insulin receptor. In one example, a competitive binding assay is performed in which human placental cell membranes are prepared as a source of insulin receptors and incubated with radiolabeled human insulin with or without the unlabeled insulin analog. The amount of bound radiolabeled insulin is then detected to determine the ability of the insulin analog to compete for binding and the relative affinity of the insulin analog for the placental insulin receptor is calculated (see e.g. Weiss et al., (2001) *J. Biol. Chem.* 276:40018-40024). Other sources of insulin receptors, including other cells that naturally or recombinantly express the insulin receptor, also can be used in such competitive binding assays (Duttaroy et al., (2005) *Diabetes* 54:251-258).

The ability of insulin to stimulate glucose uptake or effect any other of its typical metabolic outcomes can be assessed in vitro. To measure insulin-stimulated glucose uptake, adipocytes are incubated with labeled glucose, such as 2-deoxy-D-[2,6-$^3$H]glucose or D-[U-$^{14}$C]glucose with or without insulin. The incorporated radioactivity is then measured to determine the amount of glucose uptake in the presence or absence of insulin (Louveau et al., (2004) *J Endocrin.* 181:271-280, Duttaroy et al., (2005) *Diabetes* 54:251-258). When assessing the activity of an insulin analog, the activity of human insulin also can be assessed and used for comparison. In vitro assays to assess glucose production in H4IIE cells in the presence of insulin also can be performed (Wang et al., (2000) *J. Biochem.,* 275:14717-14721, Duttaroy et al., (2005) *Diabetes* 54:251-258).

In vivo studies using diabetic or healthy animal models or human subjects also can be performed to assess the therapeutic activity of insulin, including insulin compositions and co-formulations. Insulin can be administered to animal models of diabetes to assess the effects on blood glucose levels, circulating insulin levels, and hemoglobin Alc (HbAlc), for example. Hemoglobin Alc forms when glucose attaches to hemoglobin, which occurs when blood glucose levels are elevated. HbAlc levels in a blood sample can be assessed by, for example, HPLC, ELISA, RIA or other immunoassay. Normal HbAlc values for healthy subjects are approximately 4.0-6.2 percent. The American Diabetes Association recommends that it should be below 7% (or below 6% in certain persons) for patients with diabetes to help prevent the complications from diabetes. Insulin levels can be measured by, for example, ELISA or RIA. Glucose levels are typically measured using a glucose sensor or analyzer.

Animal models for type I diabetes include the nonobese diabetic (NOD) mouse and the BioBreeding (BB) rat (Atkinson et al., (1999) *Nature Med.* 5:601-604). Animal models for type 2 diabetes include, but are not limited to, ob/ob mice and db/db mice, which have mutations in the leptin gene or leptin receptor, respectively, KK mice, Nagoya-Shibata-Yasuda (NSY) mice, Zucker diabetic fatty (ZDF) rats and Gato-Katazaki (GK) rats (Cefalu (2006) *ILAR Journal*

47:186-198). In other examples, healthy animals are used to test the activity of an insulin, with or without a hyaluronan degrading enzyme.

2. Hyaluronan Degrading Enzymes

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with serum albumin. The activity is measured by incubating hyaluronidase with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity (see e.g. Example 2).

In another example, hyaluronidase activity is measured using a microtiter assay in which residual biotinylated hyaluronic acid is measured following incubation with hyaluronidase (see e.g. Frost and Stem (1997) *Anal. Biochem.* 251:263-269, U.S. Pat. Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) *Anal. Biochem.* 229:35-41; Takahashi et al., (2003) *Anal. Biochem.* 322:257-263).

The ability of a hyaluronan degrading enzyme to act as a spreading or diffusing agent also can be assessed. For example, trypan blue dye can be injected subcutaneously with or without a hyaluronan degrading enzyme into the lateral skin on each side of nude mice. The dye area is then measured, such as with a microcaliper, to determine the ability of the hyaluronan degrading enzyme to act as a spreading agent (U.S. Pat. Pub. No. 20060104968). The effect of co-administration of hyaluronidase with another agent, such as an insulin, on the pharmacokinetic and pharmacodynamic properties of that agent also can be assessed in vivo using animal model and/or human subjects, such as in the setting of a clinical trial. The functional activity of a hyaluronan degrading enzyme that is not a hyaluronidase can be compared to a hyaluronidase using any of these assays. This can be done to determine a functionally equivalent amount of a hyaluronan degrading enzyme. For example, the ability of a hyaluronan degrading enzyme to act as a spreading or diffusing agent can be assessed by injecting it into the lateral skin of mice with trypan blue, and the amount required to achieve the same amount of diffusion as, for example, 100 units of a Hyaluronidase Reference Standard, can be determined. The amount of hyaluronan degrading enzyme required is, therefore, functionally equivalent to 100 hyaluronidase units.

The stability of hyaluronan degrading enzymes in a composition, such as in the co-formulations provided herein, also can be assessed using other methods and assays known in the art. For example, stability can be assessed by determining hyaluronidase activity as described above and in Example 2, visual inspection as described above, percent recovery and protein purity, over time, as measured by reversed phase high performance liquid chromatography (RP-HPLC) (see, e.g., Example 3), and apparent melting temperature. Protein purity, as determined by RP-HPLC, is the percent of the main hyaluronan degrading enzyme in the co-formulation, for example, rHuPH20, as compared to all of the hyaluronidase species present. Percent recovery is the relative percentage of the hyaluronidase in the co-formulation over time and at various storage conditions, as compared to a reference sample. In one example, the melting temperature of the hyaluronidase in the co-formulations provided herein, is determined by measuring the hydrodynamic radius of particles by dynamic light scattering (see, e.g., Example 7.B). An increase in particle size and a decrease in the melting temperature indicates denaturation and subsequent aggregation of the hyaluronidase. Hyaluronidase stability in the co-formulations provided herein can be determined by measuring the oxidation of the hyaluronidase, such as the rHuPH20, by RP-HPLC. Percent oxidation is a measure of the sum of the peak areas of the major (ox-1) and minor (ox-2) peaks (see, e.g., Example 10.B). Other methods known to one of skill in the art that can be used to determine the stability of the hyaluronidase in the co-formulations provided herein, include polyacrylamide gel electrophoresis (PAGE), immunoblotting, nuclear magnetic resonance (NMR) spectroscopy, mass spectrometry, circular dichroism (CD) and dye-based fluorescence assays.

J. THERAPEUTIC USES

The co-formulations of a fast acting insulin and hyaluronan degrading enzyme described herein can be used for treatment of any condition for which a fast-acting insulin is employed. The co-formulations can be administered subcutaneously to treat any condition that is amenable to treatment with insulin. This section provides exemplary therapeutic uses of fast-acting insulin. The therapeutic uses described below are exemplary and do not limit the applications of the co-formulations described herein. Therapeutic uses include, but are not limited to, treatment for type 1 diabetes mellitus, type 2 diabetes mellitus, gestational diabetes, and for glycemic control in critically ill patients. For example, the co-formulations of a fast acting insulin and hyaluronan degrading enzyme can be administered subcutaneously in discrete doses, such as via a syringe or insulin pen, prior to a meal as prandial insulin therapy in subjects with diabetes to achieve glycemic control. The co-formulations also can be administered subcutaneously or intraperitonally using an insulin pump or in the context of a closed loop system to continuously control blood glucose levels throughout the day and night and/or to control post-prandial glycemic excursions. It is within the skill of a treating physician to identify such diseases or conditions.

As discussed above, particular dosages and treatment protocols are typically individualized for each subject. If necessary, a particular dosage and duration and treatment protocol can be empirically determined or extrapolated. For example, exemplary doses of fast-acting insulin without a hyaluronan degrading enzyme can be used as a starting point to determine appropriate dosages of the co-formulations provided herein. Dosage levels can be determined based on a variety of factors, such as body weight of the individual, general health, age, the activity of the specific compound employed, sex, diet, metabolic activity, blood glucose concentrations, time of administration, rate of excretion, drug combination, the severity and course of the disease, and the patient's disposition to the disease and the judgment of the treating physician. In particular, blood glucose levels, such as measured by a blood glucose sensor, can be measured and used to determine the amount of insulin and a hyaluronan degrading enzyme to be administered to achieve glycemic control. Algorithms are known in the art that can be used to determine a dose based on the rate of absorption and level of absorption of the co-formulations of a fast acting insulin and a hyaluronan degrading enzyme provided herein, and also based upon blood glucose levels. Dosages of insulin for post-prandial glycemic control also can be calculated or adjusted, for example, by determining the carbohydrate content of a meal (see, e.g., Bergenstal et al., (2008) *Diabetes Care* 31:1305-1310, Lowe et al., (2008) *Diabetes Res. Clin. Pract.* 80:439-443, Chiesa et al., (2005) *Acta Biomed.* 76:44-48).

1. Diabetes Mellitus

Diabetes mellitus (or diabetes) is characterized by an impaired glucose metabolism. Blood glucose is derived from carbohydrates absorbed in the gut and produced in the liver. Increasing blood glucose levels stimulate insulin release. The postprandial glucose influx can be 20 to 30 times higher than the hepatic production of glucose observed between meals. Early phase insulin release, lasting 10 minutes or thereabouts, suppresses hepatic glucose production and precedes a longer (late) phase of release, which lasts two hours or more and covers mealtime carbohydrate influx. Between meals, a low continuous insulin level, basal insulin, covers ongoing metabolic requirements, in particular to regulate hepatic glucose output as well as glucose utilization by adipose tissue, muscle tissue and other target sites. Patients with diabetes present with elevated blood glucose levels (hyperglycemia). Diabetes can be classified into two major groups: type 1 diabetes and type 2 diabetes. Type 1 diabetes, or insulin dependent diabetes mellitus (IDDM), is characterized by a loss of the insulin-producing β-cell of the islets of Langerhans in the pancreas, leading to a deficiency of insulin. The primary cause of the β-cell deficiency is T-cell mediated autoimmunity. Type 2 diabetes, or non-insulin dependent diabetes mellitus (NIDDM), occurs in patients with an impaired β-cell function. These patients have insulin resistance or reduced insulin sensitivity, combined with reduced insulin secretion. Type 2 diabetes may eventually develop into type I diabetes. Also included in diabetes is gestational diabetes. Patients with diabetes can be administered insulin to both maintain basal insulin levels and to prevent glycemic excursions, such as following a meal.

a. Type 1 Diabetes

Type 1 diabetes is a T-cell dependent autoimmune disease characterized by infiltration of the islets of Langerhans, the endocrine unit of the pancreas, and destruction of β-cells, leading to a deficiency in insulin production and hyperglycemia. Type 1 diabetes is most commonly diagnosed in children and young adults but can be diagnosed at any age. Patients with type 1 diabetes can present with, in addition to low insulin levels and high blood glucose levels, polyuria, polydipsia, polyphagia, blurred vision and fatigue. Patients can be diagnosed by presenting with fasting plasma glucose levels at or above 126 mg/dL (7.0 mmol/l), plasma glucose levels at or above 200 mg/dL (11.1 mmol/l) two hours after a 75 g oral glucose load, such as in a glucose tolerance test, and/or random plasma glucose levels at or above 200 mg/dL (11.1 mmol/l).

The primary treatment for patients with type I diabetes is administration of insulin as replacement therapy, which is typically performed in conjunction with blood glucose monitoring. Without sufficient replacement insulin, diabetic ketoacidosis can develop, which can result in coma or death. Patients can be administered subcutaneous injections of fast-acting insulin using, for example, a syringe or insulin pen, or an insulin pump to maintain appropriate blood glucose levels throughout the day and also to control postprandial glucose levels. In some instances, an insulin pump, including in the context of a closed loop system, can be used to deliver insulin intraperitoneally. Thus, patients with type 1 diabetes can be administered the co-formulations of a fast acting insulin and hyaluronan degrading enzyme described herein subcutaneously or intraperitoneally via syringe, insulin pen, or insulin pump, or any other means useful for delivering insulin, to more rapidly control blood glucose and insulin levels.

b. Type 2 Diabetes

Type 2 diabetes is associated with insulin resistance and, in some populations, also by insulinopenia (loss of β-cell function). In type 2 diabetes, phase 1 release of insulin is absent, and phase 2 release is delayed and inadequate. The sharp spike of insulin release occurring in healthy subjects during and following a meal is delayed, prolonged, and insufficient in amount in patients with type 2 diabetes, resulting in hyperglycemia. Patients with type 2 diabetes can be administered insulin to control blood glucose levels (Mayfield et al. (2004) *Am Fam Physican* 70:489-500). This can be done in combination with other treatments and treatment regimes, including diet, exercise and other antidiabetic therapies (e.g. sulphonylureas, biguanides, meglitinides, thiazolidinediones and alpha-glucosidase inhibitors). Thus, patients with type 2 diabetes can be administered the co-formulations of a fast acting insulin and hyaluronan degrading enzyme described herein subcutaneously or intraperitoneally via syringe, insulin pen, or insulin pump, or any other means useful for delivering insulin, to more rapidly control blood glucose and insulin levels.

c. Gestational Diabetes

Pregnant women who have never had diabetes before but who have high blood glucose levels during pregnancy are diagnosed with gestational diabetes. This type of diabetes affects approximately 1-14% of all pregnant women, depending upon the population studied (Carr et al., (1998) *Clinical Diabetes* 16). While the underlying cause remains unknown, it appears likely that hormones produced during pregnancy reduce the pregnant woman's sensitivity to insulin. The mechanism of insulin resistance is likely a post-receptor defect, since normal insulin binding by insulin-sensitive cells has been demonstrated. The pancreas releases 1.5-2.5 times more insulin in order to respond to the resultant increase in insulin resistance. Patients with normal pancreatic function are able to meet these demands. Patients with borderline pancreatic function have difficulty increasing insulin secretion and consequently produce inadequate levels of insulin. Gestational diabetes thus results when there is delayed or insufficient insulin secretion in the presence of increasing peripheral insulin resistance.

Patients with gestational diabetes can be administered insulin to control blood glucose level. Thus, patients with gestational diabetes can be administered the co-formulations of a fast acting insulin and hyaluronan degrading enzyme described herein subcutaneously via syringe, insulin pen, insulin pump or artificial pancreas, or any other means, to more rapidly control blood glucose and insulin levels.

2. Insulin Therapy for Critically Ill Patients

Hyperglycemia and insulin resistance occurs frequently in medically and/or surgically critically ill patients and has been associated with increased morbidity and mortality in both diabetic and non-diabetic patients and in patients with traumatic injury, stroke, anoxic brain injury, acute myocardial infarction, post-cardiac surgery, and other causes of critical illness (McCowen et al. (2001) Crit. Clin. Care 17:107-124). Critically ill patients with hyperglycemia have been treated with insulin to control blood glucose levels. Such treatment can reduce morbidity and mortality amongst this group (Van den Berghe et al. (2006) N. Eng. J Med. 354:449-461). Insulin is typically administered intravenously to the patient, such as by injection with a syringe by a medical practitioner or by infusion using an insulin pump. In some examples, algorithms and software are used to calculate the dose. Thus, critically ill patients with hyperglycemia can be administered a co-formulation of a fast acting insulin and hyaluronan degrading enzyme described herein to control blood glucose levels, thereby alleviating the hyperglycemia and reducing morbidity and mortality.

K. COMBINATION THERAPIES

Any of the co-formulations of a fast acting insulin and hyaluronan degrading enzyme described herein can be administered in combination with, prior to, intermittently with, or subsequent to, other therapeutic agents or procedures including, but not limited to, other biologics and small molecule compounds. For any disease or condition, including all those exemplified above, for which a fast-acting insulin is indicated or has been used and for which other agents and treatments are available, the co-formulations can be used in combination therewith. Depending on the disease or condition to be treated, exemplary combinations include, but are not limited to, combination with anti-diabetic drugs, including, but not limited to, sulfonylureas, biguanides, meglitinides, thiazolidinediones, alpha-glucosidase inhibitors, peptide analogs, including glucagon-like peptide (GLP) analogs and, gastric inhibitory peptide (GIP) analogs and DPP-4 inhibitors. In another example, the co-formulations of a fast acting insulin and hyaluronan degrading enzyme described herein can be administered in combination with, prior to, intermittently with, or subsequent to, with one or more other insulins, including fast-acting insulin, and basal-acting insulins.

L. ARTICLES OF MANUFACTURE AND KITS

The co-formulations of a fast acting insulin and hyaluronan degrading enzyme provided herein can be packaged as articles of manufacture containing packaging material, a pharmaceutical composition which is effective for controlling blood glucose levels, such as in diabetic or critically subjects, and a label that indicates that the co-formulations are to be used for controlling blood glucose levels.

The articles of manufacture provided herein contain packaging materials. Packaging materials for use in packaging pharmaceutical products are well known to those of skill in the art. See, for example, U.S. Pat. Nos. 5,323,907, 5,052, 558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment.

The co-formulations of a fast acting insulin and hyaluronan degrading enzyme also can be provided as kits. Kits can include a co-formulation described herein and an item for administration. The kits also can include additional pharmaceutical compositions. In one example, the kits can include one or more of the co-formulations provided herein and one or more other insulin compositions, such as for example, slow acting or intermediate-acting insulins, including crystalline insulins, or any combination thereof. The co-formulations of a fast acting insulin and hyaluronan degrading enzyme can be supplied with a device for administration, such as a syringe, an insulin pen, a pump, or a reservoir that is inserted into an insulin pen, a pump or other delivery device. The kit can, optionally, include instructions for application including dosages, dosing regimens and instructions for modes of administration. Kits also can include a co-formulation described herein and an item for diagnosis. For example, such kits can include a glucose monitor or sensor.

M. EXAMPLES

The following examples are included for illustrative purposes only and are not intended to limit the scope of the invention.

Example 1

Insulin and Insulin Analog Stock Preparation

A. Regular Insulin

For regular insulin, the powder (Organon Insulin API, Recombinant Human insulin SIHR 143) was weighed and mixed with a proper amount of water until the solution contained about 10-25 mg/mL insulin. 1 M HCl was added to the cloudy mixture to a final concentration of 20 mM HCl. The solution was gently mixed with a stir bar until the insulin was completely dissolved and 250 mM Tris, pH 10.7 (Trizma, Cat. No. T6066, Sigma) was added to a final Tris concentration of 20 mM. The pH was adjusted using 1 M NaOH and then water was added, such that the insulin was formulated as described in each of the individual examples below. This insulin contains approximately 13 µg/mL zinc.

B. Insulin Analogs

For the insulin analogs (either insulin Aspart or insulin Lispro), 12 vials (10 mL each) of commercial product (Insulin Lispro: Eli Lilly Humalog® (insulin Lispro) 100 U/mL, Lot A572364; Insulin Aspart: Novo Nordisk, NovoRapid® (insulin Aspart), Lot XS60195; Insulin Glulisine: Apidra® insulin) were pooled and concentrated using an Amicon Ultracel-10 K (Insulin Lispro) or 3K (Insulin Aspart) column concentrator until the final concentration was about 5 times the original concentration. The insulin analogs were precipitated by addition of 1 M sodium acetate, pH 5.3 and 30 mM zinc chloride ($ZnCl_2$, EMD, Cat No. ZX0065-1) at 1/10 of the protein solution volume. The solutions were placed on ice for 30 minutes followed by centrifugation at 5600 rpm for 20 minutes in an Avanti J-E Centrifuge with JS-5.3 swinging bucket rotor (Beckman Coulter). The supernatant was decanted and the pellet was resuspended and washed with 20 mM sodium acetate, 2 mM zinc chloride, pH 5.5 solution. The resuspended solution was centrifuged as described above. The washing step was repeated a total of 5 times. A final wash was performed with 20 mM sodium acetate, pH 5.5 to remove all traces of zinc chloride. The resulting protein paste was dissolved with water containing 20 mM HCl. After complete dissolution, 250 mM Tris, pH 10.7 was added to a final Tris concentration of 20 mM. The pH of the resulting solution was adjusted such that the insulin analog was formulated as described in each of the individual examples below and the protein concentration was adjusted to about 15-20 mg/mL. An insulin analog prepared in this way typically had a yield of about 90%, with a residual preservative concentration at less than 100 times the starting material.

Example 2

Determination of Hyaluronidase Activity of rHuPH20

Hyaluronidase activity of rHuPH20 (obtained by expression and secretion in CHO cells of a nucleic acid encoding amino acids 36-482 of SEQ ID NO:1) was determined using a turbidimetric assay. In the first two assays (A and B), the hyaluronidase activity of rHuPH20 was measured by incubating soluble rHuPH20 with sodium hyaluronate (hyaluronic acid) and then precipitating the undigested sodium hyaluronate by addition of acidified serum albumin. In the third assay (C), rHuPH20 hyaluronidase activity was measured based on the formation of an insoluble precipitate when hyaluronic acid (HA) binds with cetylpyridinium chloride (CPC). In all assays containing 600 U/mL rHuPH20 (5 µg/mL), the acceptance criteria was enzymatic activity above 375 U/mL.

A. Microturbidity Assay

In this assay, the hyaluronidase activity of rHuPH20 was measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample was measured at 640 nm after a 30 minute development period. The decrease in turbidity resulting from enzyme activity on the sodium hyaluronate substrate was a measure of the soluble rHuPH20 hyaluronidase activity. The method was performed using a calibration curve generated with dilutions of a soluble rHuPH20 assay working reference standard, and sample activity measurements were made relative to this calibration curve. Dilutions of the sample were prepared in Enzyme Diluent Solutions. The Enzyme Diluent Solution was prepared by dissolving 33.0±0.05 mg of hydrolyzed gelatin in 25.0 mL of 50 mM PIPES Reaction Buffer (140 mM NaCl, 50 mM PIPES, pH 5.5) and 25.0 mL of Sterile Water for Injection (SWFI; Braun, product number R5000-1) and diluting 0.2 mL of a 25% Human Serum Albumin (US Biologicals) solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not less than 20 µL. The minimum sample volumes needed to perform the assay were: In-process Samples, FPLC Fractions: 80 µL; Tissue Culture Supernatants: 1 mL; Concentrated Material 80 µL; Purified or Final Step Material: 80 µL. The dilutions were made in triplicate in a Low Protein Binding 96-well plate, and 30 µL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the plate to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes.

The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384 and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

B. Turbidity Assay for rHuPH20 Enzymatic Activity

Samples were diluted with Enzyme Diluent [66 mg gelatin hydrolysate (Sigma #G0262) dissolved in 50 mL Phosphate Buffer (25 mM phosphate, pH 6.3, 140 mM NaCl) and 50 mL deionized (DI) water] to achieve an expected enzyme concentration of between 0.3 and 1.5 U/mL.

Each of two test tubes labeled Standard 1, 2, 3, 4, 5, or 6, and duplicate test tubes for each sample to be analyzed (labeled accordingly) were placed in a block heater at 37° C. The volumes of Enzyme Diluent shown in the following table were added in duplicate to the Standard test tubes. 0.50 mL HA Substrate Solution [1.0 mL of 5 mg/mL hyaluronic acid (ICN #362421) in DI water, 9 mL DI water; 10 mL Phosphate Buffer] was dispensed into all the Standard and Sample test tubes. Volumes of 1.5 U/mL USP Hyaluronidase Standard (USP #31200) in Enzyme Diluent were dispensed into duplicate Standard test tubes as indicated in the Table 7 below. When all the Standard test tubes had been completed, 0.50 mL of each sample was dispensed into each of the duplicate Sample test tubes. After a 30-minute incubation at 37° C., 4.0 mL of Serum Working Solution {50 mL Serum Stock Solution [1 volume horse serum (donor herd, cell culture tested, hybridoma culture tested, USA origin), 9 volumes 500 mM Acetate Buffer, adjust to pH 3.1, allow to stand at room temperature 18-24 hours, store at 4° C.] plus 150 mL 500 mM Acetate Buffer} was added to the Standard test tubes, which were then removed from the block heater, mixed and placed at room temperature. The Sample test tubes were processed in this manner until all of the Standard and Sample test tubes were processed.

A "blank" solution was prepared by combining 0.5 mL Enzyme Diluent, 0.25 mL DI water, 0.25 mL Phosphate Buffer and 4.0 mL Serum Working Solution. The solution was mixed and an aliquot, transferred to a disposable cuvette. This sample was used to zero the spectrophotometer at 640 nm.

After a 30-minute incubation at room temperature an aliquot from each Standard test tube was transferred in turn to a disposable cuvette and the absorbance at 640 nm was measured. This procedure was repeated for the duplicate Sample test tubes.

A linear calibration curve was constructed by plotting the hyaluronidase concentration (U/mL) versus the observed absorbance. Linear regression analysis was used to fit the data (excluding the data for the 0.0 U/mL calibration standard) and to determine the slope, intercept and correlation coefficient ($r^2$). A standard curve regression equation and the observed sample absorbance were used to determine the sample concentrations.

TABLE 7

Dilutions for Enzyme Standards

| Standard | U/mL | mL Enzyme Diluent | mL 1.5 U/mL USP Hyaluronidase |
|---|---|---|---|
| 1 | 0.0 | 0.50 | 0 |
| 2 | 0.3 | 0.40 | 0.10 |
| 3 | 0.6 | 0.30 | 0.20 |
| 4 | 0.9 | 0.20 | 0.30 |
| 5 | 1.2 | 0.10 | 0.40 |
| 6 | 1.5 | 0 | 0.50 |

C. Turbidity Assay for rHuPH20 Enzymatic Activity

The turbidimetric method for the determination of hyaluronidase activity and enzyme concentration was based on the formation of an insoluble precipitate when hyaluronic acid (HA) binds with cetylpyridinium chloride (CPC). The activity was measured by incubating hyaluronidase with hyaluronan for a set period of time (30 minutes) and then precipitating the undigested hyaluronan by the addition of CPC. The turbidity of the resulting sample is measured at 640 nm and the decrease in turbidity resulting from enzyme activity on the HA substrate was a measure of the hyaluronidase potency. The method is run using a calibration curve generated with dilutions of rHuPH20 assay working reference standard, and sample activity measurements were made relative to the calibration curve. The method was intended for the analysis of rHuPH20 activity in solutions after dilution to a concentration of ~2 U/mL. The quantitative range was 0.3 to 3 U/mL, although for routine testing optimum performance was obtained in the range of 1 to 3 U/mL.

Enzyme Diluent was prepared fresh by dissolving 100 mg±10 mg gelatin hydrolysate (Sigma #G0262) in 75 mL of the Reaction Buffer Solution (140 mM NaCl, 50 mM PIPES (1,4 piperazine bis(2-ethanosulfonic acid)), pH 5.3) free acid (Mallinckrodt #V249) and 74.4 mL of Sterile Water for Irrigation (SWFI) and adding 0.6 mL 25% Human Serum Albumin (HSA). A spectrophotometer blank was prepared by adding 1.0 mL Enzyme Diluent to a test tube and placing it in a heating block preheated to 37° C. A Diluted Reference Standard was prepared by making a 1:25 dilution of the rHuPH20 Assay Working Reference Standard in triplicate by adding 120 μL of the Assay Working Reference Standard to 29.880 mL of Enzyme Diluent. Appropriate dilutions of each sample were prepared in triplicate to yield a ~2 U/mL solution.

The volumes of Enzyme Diluent were dispensed in triplicate into Standard test tubes according to Table 8. 500 μL of a solution of 1.0 mg/mL sodium hyaluronate (Lifecore, #81, with average molecular weight of 20-50 kDa) in SWFI was dispensed into all test tubes except the blank, and the tubes were placed in the 37° C. in the heating block for 5 minutes. The quantity of the Diluted Reference Standard indicated in Table 7 was added to the appropriate Standard test tubes, mixed and returned to the heating block. 500 μL of each sample to the appropriate tubes in triplicate. 30 minutes after the first Standard tube was started, 4.0 mL of Stop Solution (5.0 mg/mL cetylpyridinium chloride (Sigma, Cat #C-5460) dissolved in SWFI and passed through a 0.22 micron filter) to all tubes (including the Blank), which were then mixed and placed at room temperature.

The spectrophotometer was "blanked" at 640 nm fixed wavelength. After 30 minutes incubation at room temperature. Approximately 1 mL of Standard or Sample was transferred to a disposable cuvette and the absorbance read at 640 nm. The Reference Standard and Sample raw data values were analyzed employing GRAPHPAD PRISM® computer software (Hearne Scientific Software) using an exponential decay function constrained to 0 upon complete decay. The best fit standard curve was determined and used to calculate the corresponding Sample concentrations.

TABLE 8

Dilutions for Enzyme Standards

| Standard | U/mL | Enzyme Diluent (μL) | Diluted Reference Standard (μL) |
|---|---|---|---|
| 1 | 0.0 | 500 | 0 |
| 2 | 0.6 | 400 | 100 |
| 3 | 1.2 | 300 | 200 |
| 4 | 1.8 | 200 | 300 |
| 5 | 2.4 | 100 | 400 |
| 6 | 3.0 | 0 | 500 |

Example 3

RP-HPLC

In this example, reverse phase-HPLC (RP-HPLC) was used to determine the apparent solubility of insulin and insulin analogs and the percent purity of rHuPH20. Apparent solubility was measured as the percent insulin recovery as compared to the initial formulations/conditions.

Reference Standards

For regular insulin, Humulin® (insulin regular, 100 U) was used as the standard. For insulin Lispro, one vial of USP Lispro was reconstituted with 1.72 mL 0.01 N HCl resulting in a 3.5 mg/mL USP Lispro (100 U/mL) reference standard. For insulin Aspart, one vial of EP Aspart was reconstituted with 1.00 mL 0.01 N HCl resulting in a 3.89 mg/mL EP Aspart reference standard. For rHuPH20, three reference standards were used, each containing 2.5 μg/mL, 5.0 μg/mL or 7.5 μg/mL rHuPH20, generated by diluting a 50 μg/mL rHuPH20 sample (Lot HUB0701EB) with an appropriate amount of sample diluent (20 mM Tris, 130 mM NaCl, 0.01% Poloxamer 188, pH 7.3).

Preservative Standards

Three preservative reference standards were used, each containing 0.05% metacresol/phenol, 0.10% metacresol/phenol or 0.15% metacresol/phenol.

Sample Preparation

Samples were diluted, if necessary, in sample diluent such that the insulin/insulin analog was present at 100 U/mL and the rHuPH20 was present at 5 μg/mL. Samples were prepared by withdrawing 100 μL from each vial at every time point and centrifuging prior to loading. Samples were stored in an autosampler at 4° C. prior to use, and were considered stable for 3 days after preparation. All samples were tested in duplicate.

For insulin, 20 μL was injected for each HPLC run. For rHuPH20, 100 μL was injected for each HPLC run. The HPLC column and method parameters are set forth in Table 9 below. The HPLC gradient is set forth in Table 10 below.

TABLE 9

HPLC Column and Method Parameters

| | |
|---|---|
| Column | Phenomenex Jupiter C5 4.6 × 250 mm, 5 μM, 300 Å or Agilent Zorbax 300SB-C18 4.6 × 250 mm column (Cat No. 880995-902) |
| Injection Volume | 20 μL for Insulin content and 100 μL for rHuPH20 content |
| Blank Injections | 10 μL of Mobile Phase B |
| Column Temperature | 40° C. ± 1° C. |
| Sample Thermostat | 4° C. ± 3° C. |
| Detection λ | 280 nm |
| Mobile Phase A | 0.1% Trifluoroacetic Acid (TFA) in water |
| Mobile Phase B | 0.1% TFA in acetonitrile |
| Run Time | 39 minutes |
| Column Storage | 100% Acetonitrile |

TABLE 10

HPLC Gradient

| Time | Flow | % A | % B |
|---|---|---|---|
| 0 | 1.0 | 72 | 28 |
| 3 | 1.0 | 72 | 28 |
| 20 | 1.0 | 65 | 35 |
| 29 | 1.0 | 15 | 85 |
| 29.1 | 1.0 | 0 | 100 |
| 34 | 1.0 | 0 | 100 |
| 34.1 | 1.0 | 72 | 28 |
| 39 | 1.0 | 72 | 28 |

A. Insulin Solubility

To determine the apparent solubility, the peak area of insulin/insulin analog main peak and desamido peak were integrated and combined together to calculate the percentage relative to the standards. Solubility was expressed as relative percentage to the standard, with 100% being 120 U/mL. The data were processed using Design-Expert® 7.0 (StatEase) and the "historical data" feature. Insulin percent purity was expressed as the percent of main insulin versus all insulin species.

B. rHuPH20 Percent Purity and Percent Recovery rHuPH20 percent purity was expressed as the percent of rHuPH20 versus all rHuPH20 species. rHuPH20 percent recovery was expressed as relative percentage to the standard, with 100% being 5 μg/mL. The target specification is 3-7 μg/mL (60-140%).

Example 4

Size Exclusion Chromatography

In this example, the insulin/rHuPH20 formulations were analyzed by size exclusion high performance liquid chromatography (SEC-HPLC) to determine the relative amounts of high molecular weight protein (HMWP), i.e., covalently bound aggregates, of insulin and rHuPH20 present in the sample. For denaturing SEC, the mobile phase was L-arginine and glacial acetic acid in acetonitrile. For non-denaturing SEC, which was used as described in Example 29, the mobile phase was phosphate buffered saline.

A. Denaturing SEC

1. Reference Standards

Humulin® R (insulin regular, Lilly, concentrated, NDC 0002-8501-01) or USP Human Insulin (USP Cat #11F270) and rHuPH20 (lot HUA0703MA or HUB0701EB with their specific activities at 120,000 U/mg and 110,000 U·mg, respectively) were used as reference standards. Reference standards, containing both insulin and rHuPH20, were prepared at concentrations similar to the expected sample concentrations, i.e., 100 U/mL insulin and 5 μg/mL rHuPH20. Liquid formulations were diluted in 25 mM Tris diluent, pH 7.3. Weighed amounts of USP Human Insulin were diluted in Tris diluent spiked with TFA (2 μL TFA/mL Tris). Reference samples were stored in HPLC vials at 10° C. prior to use.

2. Sample Preparation

If necessary, samples were diluted in Tris diluent such that insulin was present in the range of 1-100 U/mL and rHuPH20 was present in the range of 1-1000 μg/mL. Samples were stored in HPLC vials at 10° C. prior to use, for up to 3 days.

3. HPLC Preparation

The mobile phase was prepared by combining 650 mL 1.0 mg/mL L-arginine, 150 mL glacial acetic acid and 200 mL acetonitrile. The HPLC column and method parameters are set forth in Table 11 below. The rHuPH20 peak occurs around 13.8 minutes and the insulin peak occurs around 20.2 minutes.

TABLE 11

HPLC Column and Method Parameters

| | |
|---|---|
| Column | Waters Insulin HMWP, 300 mm × 7.8 mm (Cat #201549) |
| Flow Rate | 0.6 mL/min |
| Injection Volume | 100 μL |
| Blank Injections | 100 μL of mobile phase, Tris, Tris TFA |
| Column Temperature | 25° C. ± 1° C. |
| Sample Thermostat | 10° C. ± 3° C. |
| Detection λ | 280 nm |
| Run Time | 30 minutes |
| Column Storage | 20% ethanol |

B. Non-Denaturing SEC

1. Reference Standards

Humalog® 100 (insulin Lispro, Eli Lilly Cat #VL-1510), NovoLog® 100 (insulin Aspart, Novo Nordisk Cat #750111) and rHuPH20 (lot T09RD02 [specific activity 122,000 U/mg], HUA0703MA [specific activity 120,000 U/mg] or HUB0701EB [specific activity 122,000 U/mg]) were used as reference standards. Reference standards, containing both insulin and rHuPH20, were prepared at concentrations similar to the expected sample concentrations, i.e., 100 U/mL insulin and 5 μg/mL rHuPH20. Reference samples were stored in HPLC vials at 10° C. prior to use.

2. Sample Preparation

If necessary, samples were diluted in sample diluent (20 mM Tris, 130 mM NaCl, 0.01% Poloxamer 188, pH 7.3) such that insulin was present in the range of 1-100 U/mL and rHuPH20 was present in the range of 1-20 µg/mL. Samples were stored in HPLC vials at 10° C. prior to use, for up to 3 days.

3. HPLC Preparation 0.5× Phosphate Buffered Saline (PBS) solution was prepared by diluting 10×PBS with HPLC grade water. The HPLC column and method parameters are set forth in Table 12 below. The rHuPH20 peak occurs around 13 minutes and the insulin peak occurs around 18.6 minutes.

TABLE 12

HPLC Column and Method Parameters

| Column | Waters Insulin HMWP, 300 mm × 7.8 mm (Cat #201549) |
|---|---|
| Flow Rate | 0.5 mL/min |
| Injection Volume | 30 µL |
| Blank Injections | 30 µL of mobile phase, sample diluent, 0.01N HCl |
| Column Temperature | 25° C. ± 1° C. |
| Sample Thermostat | 10° C. ± 3° C. |
| Detection λ | 280 nm |
| Run Time | 60 minutes |
| Column Storage | 20% ethanol |

C. Insulin Percent Purity

Insulin percent purity was expressed as percentage of the insulin main peak versus the total insulin peaks. The target specification is less than 2% high molecular weight protein, i.e., insulin aggregates.

Example 5

Test Methods—Osmolality, Turbidity and pH

In this example, test methods used to determine appearance, osmolality, turbidity and pH of the insulin/insulin analog and rHuPH20 formulations are described. These test methods are used in subsequent Examples.

A. Appearance

1. Visual Analysis

Appearance of the insulin/rHuPH20 formulations was determined by qualitative visual analysis of the insulin/rHuPH20 solution in a type I glass vial. The evaluation of the coloration and clarity of the solution was determined by comparison to that of USP (or equivalent) sterile water for irrigation (SWFI). The aqueous solution was determined to be clear if its clarity was the same as that of the SWFI. The aqueous solution was determined to be colorless if it had the appearance of the SWFI. Vials were tested at room temperature and care was taken not to cause unnecessary turbulence and/or air bubbles in the solutions while swirling and/or inverting. If necessary, vials were wiped with non-shedding or lint-free wipes and 70% ethanol prior to testing. The procedure was as follows: A directional light source with a 150 W or greater lamp was turned on. The samples were prepared in a hood. Samples to be tested were gently inverted to ensure homogeneity prior to transferring >0.5 mL using aseptic technique to a Type I glass vial for testing. A SWFI sample was prepared in the same way. The prepared test sample and SWFI vials were gently inverted to ensure homogeneity, taking care not to introduce any air bubbles. The test sample and SWFI vials were visually compared for color against a white background with the light source shining at an angle through the bottom of the vials. The solution was considered colorless if it had the same appearance of the SWFI. The test sample and SWFI vials were visually compared for clarity against a black background with the light source shining at an angle through the bottom of the vials. The solution was considered clear if its clarity was the same as that of the SWFI. Color, clarity and the presence and extent of any visible particles and/or foreign matter were recorded. The acceptance criteria was a clear, colorless solution.

2. Illuminator Method

In this method, the degree of clarity and coloration of liquids were evaluated to ensure (visually) product quality against the applicable appearance specifications. Inspection was performed in a specifically designed inspection booth with high intensity light, against a white and black background. A liquid is clear if its opalescence is not more pronounced than that of Reference Suspension I. An aqueous solution is colorless if it has the appearance of water or is not more intensely colored than the specified reference solution (reference solution B9).

Preparation of Reference Solutions

Color reference solutions were prepared by mixing dilute HCl and EP Color Standard B (Brown Standard Solution, Ricca Chemical, #2880) as set forth in Table 13 below. Reference Solutions $B_9$, $B_8$, $B_7$, $B_6$ were stored in 2 mL vials sealed with a stopper and overseal. Reference solutions were prepared daily. 2 mL SWFI was place in a vial sealed with a stopper and overseal and stored for up to 1 year.

Clarity reference solutions were prepared as follows. A primary opalescent suspension was prepared by mixing 25 mL hexamethylenetetramine (2.5 g in 25 mL SWFI) and 25 mL hydrazine sulphate (1 g in 100 mL SWFI) and allowing the solution to stand for 24 hours. The suspension was stored for up to 2 months in a glass container. The Standard or Opalescence solution was prepared by diluting 45 µL of primary opalescent solution to 2955 µL of SWFI and mixing well. This solution was stable for 3 months. Reference suspension I and II were prepared by mixing Standard or Opalescence and SWFI as set forth in Table 13 below. Reference suspensions were stored in 2 mL vials sealed with a stopper and overseal and were prepared daily.

TABLE 13

Reference Solutions

| Color | 3.3M HCl (µL) | EP Color Standard B (µL) |
|---|---|---|
| Reference $B_9$ | 2970 | 30 |
| Reference $B_8$ | 2955 | 45 |
| Reference $B_7$ | 2925 | 75 |
| Reference $B_6$ | 2850 | 150 |

| Clarity | SWFI (µL) | Standard of Opalescence (µL) |
|---|---|---|
| Reference Suspension I | 2850 | 150 |
| Reference Suspension II | 2700 | 300 |

Product samples were prepared by first mixing the product solution and then transferring 2 mL to a vial while working in a Class 100 hood. The vials were sealed with a stopper and overseal. A visual inspection booth was prepared and the intensity of the light source was checked to ensure a Lux greater than 1750. Product samples were compared to reference solutions and suspensions by visual inspection. Color was compared to SWFI and Reference solutions B₆, B₇, B₈ and B₉ as viewed horizontally against a white background. Clarity was compared to Reference suspensions I and II as viewed vertically against a black background. The degree of coloration and clarity and degree of opalescence were recorded as set forth in Table 14 below.

TABLE 14

Degree of Coloration, Clarity and Degree of Opalescence

| | Description |
|---|---|
| Degree of Coloration | |
| Colorless | Product sample is color of SWFI or is not more intensely colored than the Reference Solution B₉ |
| Less colored than $B_X$ and more colored than $B_{X+1}$; X = 6, 7 or 8 | Product sample is less colored than $B_X$ but more colored than $B_{(X+1)}$ |
| As colored as $B_X$; X = 6, 7 or 8 | Product sample is as colored as $B_X$ with X = 6, 7 or 8 |
| More colored than B₆ | Product sample is more colored than Reference Solution B₆ |
| Clarity and Degree of Opalescence | |
| Clear | Opalescence of product sample is not more pronounced than that of Reference Suspension I |
| Less clear than Reference Suspension I and clearer than Reference Suspension II | Clarity of the product sample falls between the clarity of the two Reference Suspensions (I and II). |
| Less clear than Reference Suspension II | Clarity of the product sample is less than that of Reference Suspension II |

B. Osmotic Concentration

Osmotic concentration (osmolality) was determined by freezing point depression measurement. The test method is intended for the analysis of an aqueous solution with an osmotic concentration between 100 and 500 mOsm/kg water. Freezing point depression osmometry involves pipetting a sample of the solution to be tested into a tube and placing the tube in the cooling chamber of an osmometer. The sample is supercooled (cooled below the freezing point) and then seeded (crystallization initiated) by one of a number of methods (i.e., mechanical vibration, ultrasonic vibration, thermal shock or by the addition of solid seed particles). The sample temperature rises due to the heat of fusion released during the freezing process until equilibrium; at this point only a small fraction of the water is frozen, after which more water freezes and the temperature begins to decrease again, resulting in a flat region, or plateau, in the cooling curve. The temperature at the plateau is the freezing point of the sample and can be converted to units of osmolality (osmotic concentration) by observing that 1.0 Osmole depresses the freezing point of water by 1.858° C., where 1.0 Osmole=1.0 mole of osmotically active particles=Φ(n)(C), where:
Φ=osmotic coefficient;
n=number of particles resulting from dissociation of each molecule in solution; and
C=concentration of each molecule in mol/kg water.

A calibration check (0-2000 mOsm/kg water) was performed prior to each use of the osmometer (MicroOsmette Freeze Point Osmometer, Model #5004, Precision Systems Inc.) with 500 mOsm/kg and 200 mOsm/kg standards. After the initial turn-on, 10-15 minutes of warm up time was allowed to completely equilibrate the temperature. Samples, the probe and the seed wire were wiped with a KimWipe prior to each use. Samples for testing were prepared by pipetting 50 µL of the insulin/rHuPH20 solution into a clean, dry sample tube. The tube was placed in the refrigerator well and the osmolality was measured according to standard operating procedure. This procedure was repeated two more times for a total of three independent results per insulin/rHuPH20 sample. The raw data for each reading was recorded and a reading was considered valid if all three readings were within ±5 mOsm/kg. The average value for each sample was reported. Osmolality varies based on formulation, and the acceptance criteria are listed below in each individual example.

C. Turbidity

Turbidity was determined by measuring the absorbance of an insulin/rHuPH20 solution at 350 nm. When light passes through a solution, the intensity is attenuated by the absorbance and light scattering effect from the solution. To measure the light scattering effect due to a protein in a solution, the wavelength of 350 nm was selected to avoid the effect of absorbance from the protein. The amount of light scattered is significantly affected by the concentration and size of the molecule/particles. The OD350 of a blank solution containing all components except the protein is subtracted to obtain a final reading. 200 µL samples of each insulin/rHuPH20 formulation to be tested were transferred to three adjacent wells of a 96-well UV flat bottom microtiter plate. 200 µL of each sample's respective excipient mixture (minus the protein) was added to three adjacent wells of the microtiter plate for use as a sample blank. SWFI (200 µL) was used as a plate blank. The OD350 of each sample was read in a UV-Vis Spectramax 384plus (Molecule Devices) plate reader. Each reading was recorded, the triplicate readings were averaged and the average absorbance of the respective excipient blank was subtracted, and the resulting blank adjusted turbidity was recorded.

D. pH pH was measured as described in U.S. Pharmacopeia Compendial <791> (pharmacopeia.cn/v29240/usp29nf24s0_c791.html). Acceptance criteria varied per formulation and is listed below in each individual example. In general, tight pH control (i.e., ±0.2) was necessary to ensure insulin solubility and PH20 stability. However, in non-preserved insulin, insulin solubility was not affected by pH therefore the acceptance criteria is large (i.e., pH 7.0 to 7.8).

Example 6

Stability of rHuPH20 in Commercial Formulations of Insulin and Insulin Analogs

In this example, rHuPH20 stability in commercial insulin and insulin analog formulations was determined by measuring rHuPH20 enzymatic activity after storage at 5° C. and 25° C. In short, about 1500 U/mL of rHuPH20 was prepared in a buffer containing 10 mM Hepes and 130 mM NaCl, pH 7.0. Subsequently, 0.4 mL of commercial Humulin® (each mL contains 100 U insulin, 2.5 mg/mL metacresol and 16 mg glycerin (Eli Lilly)) or Humalog® (each mL contains 100 U insulin, 3.15 mg/mL metacresol, 16 mg glycerin, 1.88 mg Na₂HPO₄, 0.0197 mg zinc ion (zinc oxide), and trace amounts of phenol (Eli Lilly)) were added to 3.6 mL of rHuPH20 solution to form an insulin-rHuPH20 or insulin-analog rHuPH20 mixture (10× dilution for insulin products, final rHuPH20 concentration of 1350 U/mL). These solutions were stored at 5° C. and 25° C. for up to 1 week. rHuPH20 enzymatic activity was measured on days 0, 1, 2, 3, and 7 as described in Example 2B above. The results are set forth in Table 15 below. As shown in Table 15, 50% of rHuPH20 activity was lost for the Humalog®-rHuPH20

(insulin Lispro-rHuPH20) combination when it was incubated for 2 days or longer at 25° C. No significant loss was observed for Humulin®-rHuPH20 stored at 25° C., presumably due to lower level of preservative in that specific product and the dilution factor.

TABLE 15 rHuPH20 Enzymatic Activity in presence of Humulin® or Humalog®

| Sample | rHuPH20 Enzymatic Activity (U/mL) | | | | |
|---|---|---|---|---|---|
|  | 0 day | 1 day | 2 days | 3 days | 7 days |
| Humulin®-PH20, 5° C. | 1339 | 1383 | 1329 | 1430 | 1332 |
| Humulin®-PH20, 25° C. | 1318 | 1401 | 1325 | 1387 | 1308 |
| Humalog®-PH20, 5° C. | 1264 | 1202 | 1172 | 1239 | 1140 |
| Humalog®-PH20, 25° C. | 1305 | 966 | 740 | 763 | 248 |

Example 7

Effects of Preservatives on rHuPH20

In this example, various common insulin and insulin analog preservatives were evaluated for their effects on the enzymatic activity and stability of rHuPH20. rHuPH20 enzymatic activity was measured as described in Example 2 above. Where applicable, rHuPH20 stability was determined by size exclusion chromatography (SEC) as described in Example 4 above.

A. rHuPH20 Enzymatic Activity

In this example, common insulin and insulin analog preservatives phenol, m-cresol and methylparaben were evaluated for their effects on the enzymatic activity of rHuPH20 at varying concentrations, temperatures and time. Each preservative was added (for a final concentration indicated in Table 16 below), to insulin/rHuPH20 formulations containing 3.7 mg/mL insulin (Organon Insulin API [Recombinant Human insulin SIHR 143] powder was used to prepare the stock solution as detailed in Example 1), and 20 µg/mL rHuPH20 in 20 mM Tris/HCl, pH 7.1 and 140 mM NaCl and the samples were incubated at the indicated temperature for the predetermined amount of time.

The results are shown in Table 16 below, which sets forth the preservative and its concentration, the incubation time and temperature, and the rHuPH20 enzymatic activity. The results are temperature dependent. The enzymatic activity of rHuPH20 was significantly reduced after one week of incubation at 35° C. when the overall preservative level was relatively high (>0.2%). In contrast, at room temperature (25° C.). and lower preservative concentrations, rHuPH20 maintains its relative activity for at least one month. Generally, as the level of preservatives increases, rHuPH20 enzymatic activity decreases. Additionally, it appears that among the three preservatives, m-cresol is the most detrimental to rHuPH20 followed by phenol and methylparaben.

TABLE 16

Effect of preservative species and concentration on rHuPH20 activity at elevated temperatures

| Preservative | Concentration (%) | Enzymatic Activity (U/mL) | | |
|---|---|---|---|---|
|  |  | 1 Month, 25° C. | 1 Week, 35° C. | 2 Weeks, 35° C. |
| Phenol | 0.05 | 2103 | 2128 | 1996 |
| Phenol | 0.1 | 1980 | 2094 | 1997 |

TABLE 16-continued

Effect of preservative species and concentration on rHuPH20 activity at elevated temperatures

| Preservative | Concentration (%) | Enzymatic Activity (U/mL) | | |
|---|---|---|---|---|
|  |  | 1 Month, 25° C. | 1 Week, 35° C. | 2 Weeks, 35° C. |
| Phenol | 0.2 | 2128 | 1995 | 1822 |
| Phenol | 0.4 | 1910 | 835 | 447 |
| m-cresol | 0.05 | 2103 | 2019 | 1955 |
| m-cresol | 0.1 | 2188 | 2147 | 2069 |
| m-cresol | 0.2 | 2013 | 466 | 185 |
| m-cresol | 0.4 | <LOD | <LOD | <LOD |
| methylparaben | 0.05 | 2061 | 1058[2] | 1018[2] |
| methylparaben | 0.1 | 1919 | 2085 | 1968 |
| methylparaben | 0.2 | 2196 | 1927 | 1590 |
| methylparaben | 0.3[1] | 2049 | 730 | 447 |
| No preservative | 0.0 | 2006 | 1984 | 1994 |

LOD, level of detection;
[1]Methylparaben is not soluble at 0.4%;
[2]These numbers were unexpectedly low and were treated as "outliers".

B. Apparent Melting Temperature (Tm) of rHuPH20

In this example, the melting temperature (Tm) of rHuPH20 in the presence and absence of m-cresol, propyl paraben or phenoxyethanol was determined by measuring the hydrodynamic radius of particles using dynamic light scattering. Particle size increase is presumably due to denaturation and subsequent aggregation of rHuPH20. As temperature increases, proteins will unfold with will lead to aggregate formation.

In brief, rHuPH20 (Lot HuB, 10 mg/mL stock) was diluted to 1 mg/mL in 25 mM Tris-HCl, pH 7.5. Indicated preservatives were spiked into the PH20 samples from a 100% stock solution. Z-average particle size was measured by dynamic light scattering using a Malvern Zeta sizer Nano-ZS as a function of increasing temperature. A total of 3 measurements were made at each temperature in a low volume quartz cuvette (Helma, 3.00 mm). The temperature started at 20° C., with a ramp of 2° C., to a final temperature of 66° C., with a 5 minute equilibration period at each temperature. Light scattering intensity was measured with a 173° backscatter detector equipped with the instrument and the cumulative Z-Average particle data was calculated with the DTS (dispersion technology software) software using a refractive index of 1.45 for the protein samples, and using a refractive index of 1.33 for water as dispersant. The inflection point on the temperature axis at which there is a significant increase in the particle size is considered to be the apparent Tm (melting temperature) where the protein is denatured and begins to aggregate.

The results are shown in Table 17 below, which sets forth the average particle size at various temperatures for 5 different PH20 formulations, as shown in Table 17 below. The data in Table 17 is an average of 3 measurements per point, at 2° C. temperature increments, with a 5 minute equilibration point. The results show that the Tm of rHuPH20 dropped from above 40° C. without any preservative down to 26° C. in the presence of 0.25% m-cresol. A similar trend was observed using differential scanning calorimetry (DSC) to measure the Tm of rHuPH20 with and without m-cresol, however the Tm reduced only about 2° C. in the presence of 0.25% m-cresol.

TABLE 17

Average particle size of rHuPH20, with and without various preservatives, as measured by Dynamic Light Scattering

| Temp. (° C.) | rHuPH20 | rHuPH20 + 0.25% m-cresol | rHuPH20 + 0.2% propyl paraben | rHuPH20 + 1.0% phenoxy-ethanol | rHuPH20 + 0.5% phenoxy-ethanol |
|---|---|---|---|---|---|
| 20 | 9.48 | 8.86 | 9.66 | 10.51 | 8.95 |
| 22 | 9.19 | 11.30 | 11.40 | 10.89 | 9.48 |
| 24 | 9.89 | 12.49 | 13.58 | 10.72 | 9.95 |
| 26 | 9.96 | 23.29 | 28.10 | 11.54 | 9.41 |
| 28 | 9.27 | 113.50 | 124.57 | 12.63 | 9.57 |
| 30 | 8.94 | 150.93 | 188.03 | 13.28 | 9.40 |
| 32 | 8.96 | 159.37 | 237.27 | 12.97 | 9.52 |
| 34 | 9.42 | 158.57 | 242.13 | 12.56 | 9.68 |
| 36 | 9.28 | 163.27 | 260.77 | 14.47 | 10.13 |
| 38 | 8.91 | — | 266.43 | 29.75 | 11.03 |
| 40 | 9.39 | — | 277.43 | 40.18 | 12.71 |
| 42 | 9.72 | — | — | 52.28 | 24.31 |
| 44 | 11.36 | — | — | 93.99 | 28.43 |
| 46 | 13.08 | — | — | 159.13 | 35.87 |
| 48 | 21.35 | — | — | 238.33 | 45.08 |
| 50 | 22.74 | — | — | 314.00 | 63.67 |
| 52 | 28.50 | — | — | 653.13 | 94.19 |
| 54 | 32.95 | — | — | 834.30 | 139.47 |
| 56 | 37.01 | — | — | 1060.73 | — |
| Estimated Tm | 44° C. | 26° C. | 26° C. | 38° C. | 42° C. |

C. Binding Affinity for rHuPH20

Titration fluorescence spectroscopy was used to measure the apparent binding affinity of the preservatives to rHuPH20 in order to further understand how preservatives interact with rHuPH20. This study was carried out at Legacy BioDesign, LLC (Johnstown, Colo.).

Insulin analogs Lispro (USP reference standard, Cat. #1342321) and Aspart (EU reference standard, Cat. #Y0000349) were received in powder form and reconstituted with 857 μL of 18 MΩ deionized water and 23 μL of 1 M HCl. 120 μL of 250 mM Tris (pH 10.65) was added to each standard solution bringing the pH to 7.4 and the volume to 1 mL. 2.5 mL of 1 mg/mL solutions of each standard and the two insulin solutions were prepared by dilution with 30 mM Tris pH 7.4. All solutions were clear and colorless at the time of dilution, except the USP insulin lispro standard, which was hazy upon dilution, but became clear within an hour of preparation. Two samples each were prepared for insulin Aspart and insulin Lispro, with the reference standard and the manufactured material. Fluorescence emission spectra of 1 mg/mL insulin solutions were collected using an Aviv Model ATF 105 Spectrofluorometer and Aviv 105 software version 1.3. A quartz fluorescence cell was loaded with 2.5 mL of solution for each measurement. Excitation was performed at 275 nm with a bandwidth of 4 nm. Emission spectra were collected between 340 nm and 280 nm with a resolution of 1 nm. PMT voltage was set to 850 V, while the reference (QC) PMT voltage was set at 250 V.

The data showed that although there was some interaction between the preservatives and rHuPH20, the three tested preservatives (m-cresol, phenol, and benzyl alcohol) did not alter the structure of rHuPH20. The apparent dissociation constants ($K_D$) for the interactions of rHuPH20 with the preservatives, ranged from 40 to 3000 μM, with most data typically in the 50 to 100 μM range. The data also indicated that although rHuPH20 is sensitive to phenolic compounds, it appears that this is a non-specific interaction and is highly dependent on the environmental temperature. The conclusion of non-specific interaction was further supported by the fact that the addition of a structurally similar compound, phenylalanine, did not protect rHuPH20 against degradation caused by m-cresol or phenol (see section E below).

D. Other Common Preservatives

In order to determine whether rHuPH20 is sensitive to all preservatives, or just to those typically used in insulin products, various other commercial preservatives were tested for their effect on rHuPH20 enzymatic activity and stability. Additionally, phenylalanine was added as a potential stabilizer to evaluate whether the detrimental effect of preservatives on rHuPH20 activity is mediated solely by the phenolic ring present on several of the deleterious preservatives. It was hypothesized that phenylalanine might be able to compete with phenolic preservatives and provide a stabilizing effect.

In these studies, a total of 100 μg/mL of rHuPH20 was added to base formulations which contained 25 mM Tris/HCl, pH 7.3, 140 mM NaCl, 0.01% polysorbate 80 and the selected preservatives at the specified level. The concentration chosen for each of the preservatives was based mainly on literature data (see, e.g., Kibbe, A. H., (2000) Handbook of Pharmaceutical Excipients, $3^{rd}$ edition, Pharmaceutical Press; Powell et al., (1998) PDA Journal of Pharmaceutical Science and Technology) and the levels known to be present in existing commercial products.

The results are set forth in Tables 18-20 below. The results show that chlorhexidine salts and thimerosal do not affect rHuPH20 enzymatic activity. In contrast, the addition of either benzalkonium chloride or 4-chloro-1-butanol caused a significant reduction in rHuPH20 enzymatic activity after just 24 hours at 25° C. The addition of either phenoxyethanol or m-cresol caused a reduction in rHuPH20 activity in a temperature dependent manner. At 4° C., the activity of rHuPH20 was about the same as the control sample that did not contain a preservative, whereas at 35° C. rHuPH20 activity was abolished in as little as 48 hours (see Table 20). Methylparaben generally had little effect on rHuPH20 enzymatic activity at 25° C. or for short time periods, e.g., 24 hours, at 35° C., but all enzymatic activity was lost after incubation at 35° C. for 6 days. Additionally, methylparaben is a less effective preservative as compared to m-cresol or phenol. The addition of phenylalanine at either low concentration (5 mM) or high concentration (50 mM) did not affect the loss or rHuPH20 activity in the presence of phenolic preservatives m-cresol and methylparaben.

TABLE 18 rHuPH20 activity with various preservatives at different storage temperatures

| Formulation | t = 0 | 24 hours, 25° C. | 5 days, 25° C. |
|---|---|---|---|
| Benzalkonium Chloride | 11,740 | 10750 | 2710 |
| 4-Chloro-1-butanol | 11,350 | 3500 | 1440 |
| Chlorhexidine dihydrochloride | 7,720 | 8130 | 8750 |
| Chlorhexidine digluconate | 9,590 | 9520 | 12310 |
| Thimerosal | 10,290 | 8990 | 8960 |
| L-Phenylalanine | 13,420 | 12100 | 11460 |
| L-Phenylalanine/m-cresol | 9,990 | 8390 | 13470 |
| L-Phenylalanine/methylparaben | 10,780 | 10620 | 9390 |
| No preservative control | 12,200 | 12410 | 10620 |

TABLE 19 rHuPH20 activity with various preservatives at different storage temperatures

| Formulation | t = 0 | 6 days, 35° C. |
|---|---|---|
| Benzalkonium Chloride | 11,740 | <LOQ |
| 4-Chloro-1-butanol | 11,350 | <LOQ |
| Chlorhexidine dihydrochloride | 7,720 | 11890 |
| Chlorhexidine digluconate | 9,590 | 12270 |
| Thimerosal | 10,290 | 10070 |
| L-Phenylalanine | 13,420 | 10660 |
| L-Phenylalanine/m-cresol | 9,990 | <LOQ |
| L-Phenylalanine/methylparaben | 10,780 | <LOQ |
| No preservative control | 12,200 | 11870 |

TABLE 20 rHuPH20 activity with various preservatives at different storage temperatures

| Formulation | 48 hours, 4° C. | 48 hours, 35° C. |
|---|---|---|
| Phenoxyethanol | 14,700 | <LOQ |
| Chlorhexidine digluconate | 12,090 | 13,110 |
| L-Phenylalanine | 12,540 | 13,130 |
| L-Phenylalanine/m-cresol | 12,250 | <LOQ |
| L-Phenylalanine/methylparaben | 10,480 | 10,690 |
| m-cresol | 10,950 | <LOQ |
| methylparaben | 10,380 | 12,660 |
| No Preservative control | 12,520 | 13,200 |

The loss of enzymatic activity caused by the addition of preservatives and elevated temperature was mainly attributed to the formation of rHuPH20 aggregates. As shown in Tables 21-22 below, at 35° C., a loss of the main peak as measured by size exclusion chromatography was concomitant with the loss or rHuPH20 enzymatic activity (see Tables 21-22). Additionally, a significant aggregate peak was observed for m-cresol containing samples when stored at 35° C. Common preservatives cause loss of rHuPH20 activity at elevated temperatures and over time. More compatible preservatives, e.g., thimerosal and chlorhexidine salts, were identified.

TABLE 21

Effect of preservatives on rHuPH20 stability as measured by SEC

| Preservatives and additives | Concentrations/ Percentages | % Main rHuPH20 peak by non-denaturing SEC | |
|---|---|---|---|
| | | 4° C., 1 day | 35° C., 1 day |
| Benzalkonium Chloride | 0.01% | 99.64 | <LOD |
| 4-Chloro-1-butanol | 0.5% | 97.89 | <LOD |
| Chlorhexidine dihydrochloride | 0.002% | 98.76 | 98.12 |
| Chlorhexidine digluconate | 0.002% | 98.35 | 98.23 |
| Thimerosal | 0.01% | 98.59 | 98.31 |
| L-Phenylalanine | 5 mM | 98.27 | 98.86 |
| L-Phenylalanine/m-cresol | 5 mM/0.25% | 97.42 | 31.29 |
| L-Phenylalanine/methylparaben | 5 mM/0.2% | 98.36 | 39.94 |
| No preservative control | 0 | 98.33 | 98.85 |

LOD: Limit of detection

TABLE 22

Effect of preservatives on rHuPH20 stability as measured by SEC

| Preservatives and additives | Concentrations/ Percentage | % Main rHuPH20 peak by non-denaturing SEC | |
|---|---|---|---|
| | | 4° C. | 35° C., |
| Phenoxyethanol | 1% | 99.81 | 8.51 |
| Chlorhexidine digluconate | 0.002% | 99.77 | 98.30 |
| L-Phenylalanine | 50 mM | 100.00 | 99.80 |
| L-Phenylalanine/m-cresol | 50 mM/0.25% | 95.10 | 3.287 |
| L-Phenylalanine/methylparaben | 50 mM/0.2% | 96.75 | 95.07 |
| m-cresol | 0.25 | 100.00 | 0.834 |
| methylparaben | 0.2 | 100.00 | 96.91 |
| No Preservative control | 0 | 99.63 | 99.75 |

E. Preservative Levels and Antimicrobial Effectiveness

Currently different regulatory agencies have different pharmacopeial criteria for antimicrobial effectiveness for pharmaceutical products designed for multiple dosing. Table 23 shows the criteria for injectable drugs to meet USP and EP criteria. Thus, it was necessary to determine minimum preservative concentrations needed to meet the various criteria in order to further evaluate the effects of the preservatives on rHuPH20.

TABLE 23

USP and EP requirements for antimicrobial effectiveness testing

| | | | Europe | |
|---|---|---|---|---|
| Requirement | Timepoint | United States USP | EPB (Minimum) | EPA (Preferred) |
| Bacterial Log Reduction* | 6 h | | | 2 |
| | 24 h | | 1 | 3 |
| | 7 d | 1.0 | 3 | — |
| | 14 d | 3.0 | — | — |
| | 28 d | No increase | No increase | No recovery |
| Fungal Log Reduction* | 7 d | No increase | | 2 |
| | 14 d | No increase | 1 | — |
| | 28 d | No increase | No increase | No increase |

*$Log_{10}$ unit reduction from initial measured inoculum; No increase: not more than 0.5 $log_{10}$ unit increase than previously measured value.

Several batches of formulations containing different levels of preservatives with targeted amounts of insulin and rHuPH20 were prepared for microbial effectiveness testing. The tests were performed according to the guidance of EP and USP by a contract analytical laboratory (Quadrants Scientific, Inc., San Diego, Calif.). The insulin/rHuPH20 formulations contained: 100 U/mL insulin (Organon Insulin API, Recombinant Human insulin SIHR 143), 5 µg/mL rHuPH20, 20 mM Tris/HCl, pH 7.2, 150 mM NaCl and 0.02% poloxamer 188. The insulin was prepared as described in Example 1 above. The various preservative containing formulations were tested for anti-microbial effectiveness against *Aspergillus niger*, *Pseudomonas aeruginosa*, *E. coli*, *Staphylococcus aureus* and *Candida albicans*. Tests were conducted by 1) adding an initial inoculum (at least $10^5$ CFU/mL) of each bacteria to the sample and 2) measuring the CFU/mL of each bacteria at 6 hours, 1 day and 7 days. Raw data (CFU/mL) was converted to a log 10 unit reduction from the measured inoculum. The formulations were tested at a temperature of 37° C. and each organism was incubated separately with each formulation.

The results are shown in Table 24, which sets forth the percentages of the preservatives and whether the combination passed or failed the antimicrobial effectiveness criteria for EPA, EPB and USP.

TABLE 24

Antimicrobial effectiveness tests of different preservative levels and combinations

| # | m-Cresol (%) | Methyl-paraben (%) | Phenol (%) | Antimicrobial Effectiveness Criteria | | |
|---|---|---|---|---|---|---|
| | | | | EPA | EPB | USP |
| 1 | — | — | 0.15 | Fail | Fail | Pass |
| 2 | — | — | 0.3 | Fail | Fail | Pass |
| 3 | 0.1 | — | — | Fail | Fail | Fail |
| 4 | 0.15 | — | — | Fail | Fail | Pass |
| 5 | 0.1 | 0.15 | — | Fail | Fail | Pass |
| 6 | 0.1 | 0.1 | — | Fail | Fail | Pass |
| 7 | 0.1 | 0.15 | — | Fail | Fail | Pass |
| 8 | 0.15 | 0.1 | — | Fail | Fail | Pass |
| 9 | 0.15 | 0.15 | — | Fail | Pass | Pass |
| 10 | 0.1 | — | 0.1 | Fail | Fail | Pass |
| 11 | 0.1 | — | 0.15 | Fail | Pass | Pass |
| 12 | 0.15 | — | 0.1 | Fail | Pass | Pass |
| 13 | 0.15 | — | 0.15 | Fail | Pass | Pass |
| 14 | 0.1 | 0.15 | — | Fail | Fail | Pass |
| 15 | — | 0.15 | 0.15 | Fail | Fail | Pass |
| 16 | — | 0.15 | 0.2 | Fail | Fail | Pass |
| 17 | — | 0.2 | 0.15 | Fail | Fail | Pass |
| 18 | — | 0.2 | 0.2 | Fail | Fail | Pass |
| Humalog® | 0.315 | — | — | Pass* | Pass* | Pass* |
| NovoLog® | 0.172 | — | 0.15 | Fail* | Pass* | Pass* |

*Result, based on 7 day value.

In order to determine suitable preservative levels that meet the USP antimicrobial effectiveness criteria, a further study of combinations of benzyl alcohol, phenol and m-cresol was undertaken. The basic formulation contains: 3.75 mg/mL insulin (Organon Insulin API, Recombinant Human insulin SIHR 143 and the stock solution was prepared in the say way as detailed in Example 1), 5 µg/mL rHuPH20, 20 mM tris/HCl, pH 7.4, 140 mM NaCl and 0.02% poloxamer 188. The results are shown in Table 25 below, which sets forth the percentages of the preservatives and whether the combination passed or failed the antimicrobial effectiveness criteria for USP. With the exception of formulation #2, all combinations passed the USP microbial effectiveness criteria.

TABLE 25

USP Antimicrobial effectiveness tests of different preservative levels and combinations

| # | Benzyl Alcohol (%) | Phenol (%) | m-Cresol (%) | USP Antimicrobial Effectiveness Criteria* | | |
|---|---|---|---|---|---|---|
| | | | | 7 days | 14 days | 28 days |
| 1 | 0.25 | 0.1 | — | Pass | Pass | Pass |
| 2 | 0.1 | 0.15 | — | Fail | Pass | Pass |
| 3 | 0.1 | 0.1 | — | Pass | Pass | Pass |
| 4 | 0.05 | 0.2 | — | Pass | Pass | Pass |
| 5 | 0.05 | 0.15 | — | Pass | Pass | Pass |
| 6 | 0.05 | 0.1 | — | Pass | Pass | Pass |
| 7 | 0.1 | — | 0.1 | Pass | Pass | Pass |
| 8 | 0.05 | — | 0.1 | Pass | Pass | Pass |
| 9 | 0.05 | — | 0.15 | Pass | Pass | Pass |
| 10 | 0.5 | — | — | Pass | Pass | Pass |
| 11 | — | 0.1 | 0.08 | Pass | Pass | Pass |
| 12 | — | 0.1 | 0.06 | Pass | Pass | Pass |
| 13 | — | 0.08 | 0.08 | Pass | Pass | Pass |
| 14 | — | 0.06 | 0.1 | Pass | Pass | Pass |
| 15 | — | 0.08 | 0.1 | Pass | Pass | Pass |

Similar experiments were conducted with other percentage combinations of phenol and m-cresol. The results are depicted in Table 26.

TABLE 26

Minimum preservative levels necessary for USP and EPB guidelines

| criteria | | 24 hours | | | 7 days | | | 14 days | | | standard | |
|---|---|---|---|---|---|---|---|---|---|---|---|---|
| | | bacteria | | | bacteria | | | fungi | | fungi | | |
| phenol % | m-cresol % | PA | EC | SA | PA | EC | SA | AN | CA | AN | CA | UPS | EPB |
| 0.10 | 0.15 | >4.5 | 1.9 | 0.9 | >4.5 | >48. | >4.8 | 2.9 | 2.0 | >4.2 | >4.4 | pass | pass |
| 0.15 | 0.10 | >4.1 | 0.7 | 0.3 | >4.6 | >4.7 | >4.9 | 2.0 | 1.6 | >3.8 | >4.3 | pass | fail |
| 0.175 | 0.10 | >4.6 | 1.0 | 0.3 | >4.6 | >4.7 | >4.8 | 2.5 | 1.8 | >4.4 | >4.3 | pass | fail |
| 0.20 | 0.10 | >4.5 | 2.0 | 0.7 | >4.5 | >4.7 | >4.9 | 3.0 | 2.5 | >4.4 | >4.2 | pass | pass |

TABLE 26-continued

Minimum preservative levels necessary for USP and EPB guidelines

| criteria | | 24 hours bacteria | | | 7 days bacteria | | | 14 days fungi | | fungi | | standard | |
|---|---|---|---|---|---|---|---|---|---|---|---|---|---|
| phenol % | m-cresol % | PA | EC | SA | PA | EC | SA | AN | CA | AN | CA | UPS | EPB |
| 0.125 | 0.125 | >4.6 | 1.1 | 0.4 | >4.6 | >4.8 | >4.9 | 2.5 | 2.1 | >4.3 | >4.2 | pass | fail |
| 0.15 | 0.125 | >4.5 | 2.1 | 0.7 | >4.5 | >4.8 | >4.8 | 2.9 | 2.8 | >4.4 | >4.4 | pass | pass |
| 0.175 | 0.125 | >4.6 | 3.6 | 1.0 | >4.6 | >4.8 | >4.6 | 3.5 | 2.6 | >4.3 | >4.4 | pass | pass |
| 0.125 | 0.15 | >4.5 | 4.1 | 1.0 | >4.5 | >4.7 | >4.7 | 3.8 | 4.0 | >4.3 | >4.6 | pass | pass |

PA: *Pseudomonas aeruginosa*;
EC: *Escherichia coli*;
SA: *Staphylococcus aureus*;
AN: *Aspergillus niger*;
CA: *Candida albicans*.

Example 8

Effect of Combinations of Preservatives and NaCl and pH on the Solubility of Insulin and the Enzymatic Activity of rHuPH20

A. Effect of Combinations of Preservatives on rHuPH20 Enzymatic Activity

In this example, combinations of common insulin and insulin analog preservatives were tested for their effects on the enzymatic activity of rHuPH20 at varying concentrations at a temperature of 30° C. for 1 month. Each preservative was added (for final percentages indicated in Table 27 below), to insulin/rHuPH20 formulations containing 100 U/mL insulin, 5 µg/mL (600 U/mL) rHuPH20, 20 mM Tris/HCl, pH 7.2, 150 mM NaCl and 0.02% poloxamer 188 and the samples were tested at T=0 and after 1 month incubation at 30° C. Insulin was prepared as described in Example 1 above and rHuPh20 was prepared as described in Example 2.

The results are set forth in Table 27 below, which sets forth the preservatives and their percentages, and the rHuPH20 enzymatic activity at time T=0 and after 1 month incubation at 30° C. The results show that incubation of insulin/rHuPH20 for 1 month at 30° C. in the presence of one or a combination of phenolic preservatives causes a reduction in the enzymatic activity of rHuPH20.

TABLE 27

Effect of phenolic preservative combinations on rHuPH20 activity

| | Formulation | | | PH20 activity (U/mL) | |
|---|---|---|---|---|---|
| # | m-Cresol (%) | Methylparaben (%) | Phenol (%) | T = 0 | 1 Month, 30° C. |
| 1 | — | — | 0.15 | 629 | 564 |
| 2 | — | — | 0.3 | 579 | 490 |
| 3 | 0.1 | — | — | 621 | 549 |
| 4 | 0.15 | — | — | 601 | 538 |
| 5 | 0.1 | 0.15 | — | 569 | 474 |
| 6 | 0.1 | 0.1 | — | 351 | 404 |

TABLE 27-continued

Effect of phenolic preservative combinations on rHuPH20 activity

| | Formulation | | | PH20 activity (U/mL) | |
|---|---|---|---|---|---|
| # | m-Cresol (%) | Methylparaben (%) | Phenol (%) | T = 0 | 1 Month, 30° C. |
| 7 | 0.1 | 0.15 | — | 557 | 481 |
| 8 | 0.15 | 0.1 | — | 545 | 418 |
| 9 | 0.15 | 0.15 | — | 530 | 256 |
| 10 | 0.1 | — | 0.1 | 585 | 526 |
| 11 | 0.1 | — | 0.15 | 578 | 487 |
| 12 | 0.15 | — | 0.1 | 550 | 390 |
| 13 | 0.15 | — | 0.15 | 553 | 262 |
| 14 | 0.1 | 0.15 | — | 544 | 465 |
| 15 | — | 0.15 | 0.15 | 546 | 484 |
| 16 | — | 0.15 | 0.2 | 545 | 392 |
| 17 | — | 0.2 | 0.15 | 533 | 407 |
| 18 | — | 0.2 | 0.2 | 513 | 215 |

In this example, combinations of phenol and m-cresol were tested for their effects on the enzymatic activity of rHuPH20 at varying concentrations, temperatures and incubation times. Each preservative was added (for final percentages indicated in Table 28 below), to insulin/rHuPH20 formulations containing 100 U/mL insulin, 5 µg/mL (600 U/mL) rHuPH20, 20 mM Tris/HCl, pH 7.4, 50 mM NaCl, 50 mL glycerin, 50 mM methionine, and 0.01% poloxamer 188.

The results are set forth in Tables 28 below, which sets forth the preservatives and their percentages, and the rHuPH20 enzymatic activity at various incubation times and temperatures. As was observed above, storage temperature has a significant effect on enzymatic activity. Regardless of preservative, samples that were incubated at 30° C. or 37° C. had significantly reduced enzymatic activity as compared to those incubated at 25° C. Additionally, m-cresol is more deleterious on the activity of rHuPH20 than phenol. As the percentage of m-cresol was increased, the enzymatic activity of rHuPH20 decreased.

TABLE 28

Effect of phenol and m-cresol combinations on rHuPH20 activity

| | | | rHuPH20 activity, U/mL | | | | |
|---|---|---|---|---|---|---|---|
| Formulation | Phenol % | m-cresol % | 25° C., 1 week | 25° C., 2 weeks | 30° C., 1 week | 30° C., 2 weeks | 37° C., 3 days |
| F1 | 0.35 | — | 603 | 569 | 178 | 72 | 5 |
| F2 | 0.2 | 0.1 | 574 | 493 | 114 | 29 | 13 |
| F3 | 0.25 | 0.1 | 475 | 356 | 23 | 0.3 | 8 |
| F4 | 0.175 | 0.15 | 462 | 342 | 10 | 0 | 26 |
| F5 | 0.2 | 0.15 | 385 | 297 | 0 | ND | 10 |
| F6 | 0.15 | 0.175 | 421 | 318 | 3 | ND | 22 |
| F7 | 0.2 | 0.175 | 265 | 141 | 0 | ND | 15 |
| F8 | — | 0.25 | 401 | 332 | 3 | ND | 18 |

ND, Not determined.

B. Effect of NaCl and pH on Insulin Lispro Solubility and rHuPH20 Enzymatic Activity In this example, a full factorial study design was employed to determine the effects of NaCl and pH on the solubility of insulin Lispro and the enzymatic activity of rHuPH20 in the presence of 0.15% meta-cresol (m-cresol) and 0.15% phenol. Four different pH values and 4 concentrations of NaCl were evaluated, generating a total of 16 samples.

All components, except pH and NaCl were kept constant at 120 U/mL insulin Lispro, 5 µg/mL rHuPH20, 20 mM Tris/HCl (Trizma, Sigma, Cat No. T6066), 0.15% m-cresol, 0.15% phenol, 0.01% Poloxamer 188 (Poloxamer 188, Spectrum, Cat No. P1169), and 0.1 mM added $ZnCl_2$ (EMD, Cat No. ZX0065-1). The pH values tested were 7.0, 7.2, 7.4 and 7.6. The NaCl concentrations tested were 50, 80, 110 and 140 mM. The preservatives were phenol (Riedel-dh Haen, 16017, multiple compendia) and m-cresol (Fluka, Cat No. 65996). Percent insulin Lispro recovery was determined for each sample, after storage at 2-8° C. for 0, 0.25, 0.5, 1, 3, 5, 9 and 12 months. rHuPH20 enzymatic activity was measured for each sample, after storage at 5° C. for 2 weeks, 1, 5, 9 and 12 months, 25° C. for 1 week, 2 weeks and 1 month, 30° C. for 1 week and 2 weeks, and 35° C. for 1 week.

To prepare the 16 samples, 4 stock solutions, each with a different NaCl concentration, were prepared. Insulin Lispro was prepared as described in Example 1 above, with the final insulin pH set at 7.6. All of the other common components were added to their final concentrations. The pH of each stock solution was then titrated with 1 N or 0.1 N NaOH from 7.6 down to 7.0, sequentially. The precision of pH was controlled at ±0.02. Each time the designated pH was reached, 1 mL of the solution was removed and filled into a 2 mL type-1 glass vial. Once all the samples were prepared, they were stored at 2-8° C. until the tests were performed. Reverse Phase-HPLC (RP-HPLC) was performed as described in Example 3 above with the following modifications. The mobile phase started with 75% 0.1% trifluoroacetic acid (TFA) in water (A) and 25% 0.1 TFA in acetonitrile (B) with a linear gradient to 68% A+32% B over 16 minutes, with a hold for 4 minutes, followed by a linear increase to 100% B for 5 minutes.

Table 29 below, sets forth the solubility, expressed as % remaining of the original concentration (120 U/mL), after storage at 2-8° C. for 12 months. Tables 30-31 below, set forth the rHuPH20 enzymatic activity after various time points at different temperatures. Table 32 below sets forth the rHuPH20 percent recovery after various time points at different temperatures. The results of insulin Lispro solubility and rHuPH20 activity are summarized below.

Insulin Lispro Solubility

As is shown in Table 29 below, insulin Lispro is stable at low salt concentrations and high pH. For example, at pH 7.6, insulin Lispro was stable for at least 12 months at 50 and 80 mM NaCl, whereas it was stable for only 2 weeks at 140 mM NaCl. In contrast, at pH 7.0, insulin Lispro was only stable at 50 mM NaCl for 5 months. Solubility dropped below 65% when after just 1 week at 80, 110 or 140 mM NaCl.

rHuPH20 Enzymatic Activity

As is shown in Tables 29-30 below, rHuPH20 is stable at high salt concentrations and low pH. rHuPH20 is stable at 5° C. for 12 months, albeit with a lower rHuPH20 activity at 50 mM NaCl then at 140 mM NaCl. At 25° C., rHuPH20 enzymatic activity was greatly reduced at low salt concentrations after just one week at pH 7.6 and after 2 weeks at lower pH. At 30° C., rHuPH20 retained useful enzymatic activity only at a concentration of 140 mM NaCl and a pH of 7.0. After one week at 35° C., no meaning rHuPH20 enzymatic activity remained.

TABLE 29

Solubility of Insulin Lispro at 2-8° C.

| | | | % Insulin Recovery (months) | | | | | | | |
|---|---|---|---|---|---|---|---|---|---|---|
| Form # | pH | NaCl | 0 | 0.25 | 0.5 | 1 | 3 | 5 | 9 | 12 |
| F16 | 7.0 | 50 | 96.41 | 95.91 | 95.12 | 93.26 | 81.51 | 88.84 | 72.51 | 58.91 |
| F12 | 7.0 | 80 | 96.36 | 64.78 | 40.76 | 35.90 | 33.47 | 32.72 | 29.34 | 26.22 |
| F8 | 7.0 | 110 | 96.35 | 31.18 | 19.52 | 18.50 | 15.05 | 14.72 | 14.23 | 13.63 |
| F4 | 7.0 | 140 | 95.78 | 21.70 | 15.04 | 13.80 | 11.11 | 11.14 | 11.13 | 10.08 |
| F15 | 7.2 | 50 | 96.68 | 95.95 | 95.80 | 95.42 | 95.64 | 96.28 | 98.59 | 91.50 |
| F11 | 7.2 | 80 | 96.50 | 96.06 | 95.81 | 86.34 | 60.90 | 61.48 | 50.74 | 47.02 |
| F7 | 7.2 | 110 | 96.45 | 66.09 | 39.64 | 32.94 | 58.68 | 28.02 | 23.68 | 21.88 |
| F3 | 7.2 | 140 | 95.82 | 37.37 | 25.12 | 23.62 | 19.03 | 17.15 | 15.99 | 15.90 |

TABLE 29-continued

Solubility of Insulin Lispro at 2-8° C.

% Insulin Recovery (months)

| Form # | pH | NaCl | 0 | 0.25 | 0.5 | 1 | 3 | 5 | 9 | 12 |
|---|---|---|---|---|---|---|---|---|---|---|
| F14 | 7.4 | 50 | 96.74 | 96.44 | 96.36 | 95.89 | 95.90 | 96.58 | 98.78 | 95.82 |
| F10 | 7.4 | 80 | 96.34 | 96.51 | 96.49 | 96.64 | 96.05 | 96.25 | 98.62 | 95.61 |
| F6 | 7.4 | 110 | 96.69 | 96.86 | 93.50 | 74.63 | 63.68 | 68.64 | 43.83 | 38.80 |
| F2 | 7.4 | 140 | 95.73 | 83.13 | 50.31 | 39.27 | 37.45 | 34.80 | 27.30 | 24.01 |
| F13 | 7.6 | 50 | 95.66 | 96.72 | 97.02 | 96.38 | 96.21 | 96.71 | 98.74 | 96.11 |
| F9 | 7.6 | 80 | 95.48 | 95.96 | 96.22 | 96.34 | 95.43 | 96.17 | 96.91 | 92.06 |
| F5 | 7.6 | 110 | 95.47 | 96.74 | 96.40 | 96.35 | 95.89 | 95.50 | 84.82 | 91.38 |
| F1 | 7.6 | 140 | 95.73 | 95.53 | 94.46 | 87.46 | 64.62 | 67.99 | 46.20 | 41.61 |

TABLE 30

Effect of salt and pH on rHuPH20 Enzymatic Activity at 35° C., 30° C. and 25° C.

| | | | Enzyme Actvity (U/mL) | | | | | |
|---|---|---|---|---|---|---|---|---|
| Form | NaCl | | 35° C. | 30° C. | | 25° C. | | |
| # | (mM) | pH | t = 0 | 1W | 1W | 2W | 1W | 2W | 1M |
| F1 | 140 | 7.6 | 588 | —* | 244 | 133 | 545 | 528 | 461 |
| F2 | 140 | 7.4 | 593 | 15 | 322 | 238 | 557 | 494 | 496 |
| F3 | 140 | 7.2 | 583 | 31 | 370 | 300 | 585 | 530 | 514 |
| F4 | 140 | 7.0 | 576 | 84 | 418 | 387 | 579 | 507 | 513 |
| F5 | 110 | 7.6 | 577 | — | 163 | 73 | 525 | 496 | 412 |
| F6 | 110 | 7.4 | 574 | — | 256 | 159 | 541 | 489 | 449 |
| F7 | 110 | 7.2 | 581 | 14 | 327 | 257 | 565 | 501 | 505 |
| F8 | 110 | 7.0 | 580 | 49 | 376 | 304 | 576 | 512 | 512 |
| F9 | 80 | 7.6 | 599 | 9 | 152 | 82 | 498 | 430 | 385 |
| F10 | 80 | 7.4 | 574 | — | 91 | 17 | 451 | 401 | 290 |
| F11 | 80 | 7.2 | 544 | — | 230 | 133 | 522 | 444 | 416 |
| F12 | 80 | 7.0 | 549 | — | 283 | 199 | 518 | 448 | 435 |
| F13 | 50 | 7.6 | 526 | — | 38 | — | 361 | 296 | 178 |
| F14 | 50 | 7.4 | 535 | — | 47 | 5 | 426 | 329 | 265 |
| F15 | 50 | 7.2 | 529 | 14 | 115 | 51 | 481 | 371 | 324 |
| F16 | 50 | 7.0 | 522 | — | 172 | 87 | 507 | 405 | 339 |

W = week, M = month
*Below limit of detection

TABLE 31

Effect of salt and pH on rHuPH20 Enzymatic Activity at 5° C.

| Form | NaCl | | Enzyme Activity (U/mL) | | | | | |
|---|---|---|---|---|---|---|---|---|
| # | (mM) | pH | t = 0 | 2W | 1M | 5M | 9M | 12M |
| F1 | 140 | 7.6 | 588 | 613 | 597 | 595 | 524 | 539 |
| F2 | 140 | 7.4 | 593 | 572 | 594 | 586 | 542 | 551 |
| F3 | 140 | 7.2 | 583 | 563 | 592 | 586 | 537 | 546 |
| F4 | 140 | 7.0 | 576 | 569 | 586 | 582 | 555 | 559 |
| F5 | 110 | 7.6 | 577 | 569 | 582 | 582 | 532 | 552 |
| F6 | 110 | 7.4 | 574 | 655 | 592 | 618 | 560 | 580 |
| F7 | 110 | 7.2 | 581 | 574 | 581 | 593 | 553 | 553 |
| F8 | 110 | 7.0 | 580 | 564 | 588 | 615 | 551 | 576 |
| F9 | 80 | 7.6 | 599 | 540 | 584 | 546 | 515 | 534 |
| F10 | 80 | 7.4 | 574 | 613 | 557 | 565 | 510 | 488 |
| F11 | 80 | 7.2 | 544 | 536 | 548 | 566 | 518 | 536 |
| F12 | 80 | 7.0 | 549 | 536 | 548 | 575 | 514 | 520 |
| F13 | 50 | 7.6 | 526 | 518 | 514 | 508 | 465 | 456 |
| F14 | 50 | 7.4 | 535 | 521 | 525 | 527 | 466 | 473 |
| F15 | 50 | 7.2 | 529 | 518 | 544 | 482 | 452 | 456 |
| F16 | 50 | 7.0 | 522 | 574 | 543 | 494 | 437 | 438 |

W = week, M = month

TABLE 32

Effect of salt and pH on rHuPH20 % Recovery

| | | | % rHuPH20 Recovery | | | | | |
|---|---|---|---|---|---|---|---|---|
| Form # | NaCl (mM) | pH | 35° C. 1W | 30° C. 2W | 25° C. 1M | 5° C. 1M | 5° C. 9M | 5° C. 12M |
| F1 | 140 | 7.6 | 41.90 | 52.70 | 70.78 | 101.78 | 94.05 | 76.91 |
| F2 | 140 | 7.4 | 42.91 | 67.13 | 83.24 | 98.45 | 93.36 | 80.46 |
| F3 | 140 | 7.2 | 49.99 | 68.94 | 89.84 | 102.18 | 102.07 | 75.42 |
| F4 | 140 | 7.0 | 49.55 | 70.64 | 91.10 | 97.59 | 101.54 | 78.66 |
| F5 | 110 | 7.6 | 37.50 | 53.04 | 82.95 | 96.95 | 92.45 | 81.42 |
| F6 | 110 | 7.4 | 45.20 | 58.19 | 88.46 | 107.24 | 97.80 | 79.46 |
| F7 | 110 | 7.2 | 42.96 | 59.21 | 86.68 | 93.10 | 108.11 | 80.83 |
| F8 | 110 | 7.0 | 45.31 | 64.58 | 89.49 | 102.01 | 92.18 | 85.45 |
| F9 | 80 | 7.6 | 42.91 | 56.60 | 73.76 | 90.92 | 92.18 | 78.13 |
| F10 | 80 | 7.4 | 34.26 | 53.21 | 73.82 | 88.45 | 98.33 | 75.11 |
| F11 | 80 | 7.2 | 38.33 | 59.21 | 82.78 | 87.93 | 95.23 | 78.77 |
| F12 | 80 | 7.0 | 37.83 | 56.55 | 78.93 | 97.18 | 101.16 | 74.05 |
| F13 | 50 | 7.6 | 34.87 | 49.07 | 42.13 | 87.93 | 83.47 | 69.38 |
| F14 | 50 | 7.4 | 40.29 | 52.53 | 60.91 | 92.41 | 90.85 | 71.76 |
| F15 | 50 | 7.2 | 39.56 | 52.47 | 69.92 | 87.76 | 91.54 | 73.41 |
| F16 | 50 | 7.0 | 38.50 | 50.55 | 72.96 | 97.30 | 93.52 | 74.10 |

W = week, M = month

Example 9

Effect of NaCl and pH on Insulin Stability and rHuPH20 Enzymatic Activity Under Different Combinations of Preservatives In this example, the effects of NaCl and pH on insulin (regular insulin) and/or insulin analog (lispro or aspart) stability, and rHuPH20 enzymatic activity, were determined for various storage conditions, including short term and long term storage (7 days, 5 months or 9 months) at 2-8° C. and short term storage (one month or less) at elevated temperatures, including 35° C., 30° C. and 25° C.

The basic formulations are set forth in sections A-C below. For each individual study, pH and NaCl concentration were varied while the other components of the compositions remained the same. To prepare the samples for each of the insulin/insulin analogs at each of the predetermined preservative combinations, 4 stock solutions were prepared for each of the insulin and/or insulin analogs. Insulin and insulin analog stocks were prepared as described in Example 1 above, with the final insulin pH set at 7.6. Every stock solution contained the proper levels of preservatives and NaCl concentrations (50, 80, 110 or 140 mM), and all of the other common components which were added to their final concentrations. The pH of each stock solution was then titrated with 1 N or 0.1 N NaOH from 7.6 down to the final target pH, sequentially. The precision of pH was controlled at ±0.02. Each time the designated pH was reached, 1 mL of the solution was removed, filtered through a 0.2 micron PES filter, and filled into a 2 mL type-1 glass vial. Once all the samples were prepared, they were stored at 2-8° C. until the tests were performed.

A. Full Factorial Study for Effects of NaCl and pH on Insulin/Insulin Analog Solubility at 2-8° C. for 7 Days In this example, a full factorial study design was employed to determine the effects of NaCl and pH on the solubility of regular insulin and analogs lispro or aspart in the presence of different combinations of preservatives. Other formulation components, except pH, NaCl and preservatives, were kept constant at: 120 U/mL insulin/insulin analog, 5 µg/mL rHuPH20 (600 U/mL), 20 mM Tris/HCl (Trizma, Sigma, Cat No. T6066), 0.02% Pluronic® F68 (Poloxamer 188, Spectrum, Cat No. P1169), and 0.1 mM $ZnCl_2$ (EMD, Cat No. ZX0065-1). Three different combinations of preservative levels were utilized: 1) 0.15% m-cresol (Fluka, Cat No. 65996) and 0.2% phenol (Riedel-dh Haen, 16017, multiple compendia); 2) 0.15% m-cresol and 0.15% phenol; and 3) 0.15% m-cresol and 0.2% methylparaben (Fluka, Cat No. 85265). With each preservative combination, a full combination of 6 levels of pH and 4 levels of NaCl concentrations (total of 24 samples) were generated. The pH values tested were 6.6, 6.8, 7.0, 7.2, 7.4 and 7.6. The NaCl concentrations tested were 50, 80, 110 and 140 mM.

Reverse Phase-HPLC (RP-HPLC) was performed as described in Example 3 above with the following modifications. The mobile phase started with 75% 0.1% trifluoroacetic acid (TFA) in water (A) and 25% 0.1% TFA in acetonitrile (B) with a linear gradient to 68% A+32% B over 16 minutes, with a hold for 4 minutes, followed by a linear increase to 100% B for 5 minutes. The results are shown in Tables 33-35 below, which set forth the solubility, expressed as % remaining of the original concentration (120 U/mL), after storage at 2-8° C. for 7 days. Table 33 sets forth the results for Lispro. Table 34 sets forth the results for regular insulin. Table 35 sets forth the results for Insulin Aspart.

All three insulin/insulin analog molecules responded similarly to pH and NaCl concentration. At low pH and high NaCl concentrations, the insulin/insulin analogs formed crystals and precipitates, as indicated by a decrease in the percentage of remaining insulin/insulin analog. These results were verified by visual inspection. All three insulin/insulin analogs were soluble in all preservative combinations for pH≥7.2 at 50 mM NaCl, pH≥7.4 at 80 mM NaCl and at pH≥7.6 at 110 mM NaCl. Similarly, all three insulin/insulin analogs were not adequately soluble (observed concentration <90 U/mL or 75%) for pH≤6.8 at 140 mM NaCl and pH 6.6 at both 80 and 110 mM NaCl. The exact trends for solubility varied among the three insulin/insulin analogs. Under the tested conditions, insulin Aspart was the most soluble followed by insulin Lispro and regular insulin, which was the least soluble. There were also differences in preservative compatibility, which insulin Aspart and regular insulin most soluble in 0.15% phenol and 0.15% m-cresol and insulin Lispro most soluble in 0.15% m-cresol and 0.2% methylparaben. Methylparaben appears to be a better preservative when the salt concentration is low, however, at higher salt concentrations, no difference was observed between samples containing phenol or methylparaben.

Regular insulin did not completely dissolve at higher (>110 mM) NaCl concentrations, even at high pH. Table 34 confirms insulin's low solubility, with more than 50% of the test conditions having insulin concentrations below the 90% of the original values after only 7 days at 2-8° C. Reducing the phenol concentration and/or replacing the phenol with methylparaben increases the solubility slightly. Under these experiments, the loss in solubility accompanying a 30 mM increase in NaCl concentration was comparable to a 0.2 pH unit reduction. This data demonstrates that high NaCl concentrations will affect insulin solubility during 5° C. storage and thus regular insulin formulations will likely require reduced NaCl concentration and/or increased pH relative to the insulin analogs.

TABLE 33

Solubility of Lispro after 7 days at 2-8° C.

| pH | NaCl concentration (mM) | | | |
|---|---|---|---|---|
| | 50 | 80 | 110 | 140 |
| 0.2% phenol + 0.15% m-cresol formulation | | | | |
| 7.6 | 97.5 | 97.7 | 97.3 | 96.8 |
| 7.4 | 97.7 | 97.6 | 97.0 | 96.9 |
| 7.2 | 97.6 | 97.4 | 95.2 | 90.8 |
| 7.0 | 97.4 | 95.5 | 75.2 | 65.3 |
| 6.8 | 91.4 | 65.1 | 44.9 | 40.4 |
| 6.6 | 52.8 | 32.8 | 26.0 | N/A |
| 0.15% phenol + 0.15% m-cresol formulation | | | | |
| 7.6 | 100.9 | 102.1 | 101.6 | 101.3 |
| 7.4 | 100.8 | 101.8 | 100.7 | 98.4 |
| 7.2 | 100.5 | 99.2 | 97.3 | 93.1 |
| 7.0 | 98.7 | 96.4 | 77.0 | 61.2 |
| 6.8 | 93.6 | 60.8 | 44.9 | 35.9 |
| 6.6 | 60.3 | 43.3 | 24.2 | 27.7 |
| 0.2% methylparaben + 0.15% m-cresol formulation | | | | |
| 7.6 | 95.7 | 98.3 | 100.2 | 98.8 |
| 7.4 | 95.6 | 98.2 | 99.9 | 98.5 |
| 7.2 | 95.7 | 97.9 | 99.6 | 98.0 |
| 7.0 | 95.3 | 98.1 | 94.1 | 65.6 |
| 6.8 | 82.3 | 62.6 | 47.8 | 42.0 |
| 6.6 | 42.0 | 28.2 | 24.1 | 25.9 |

TABLE 34

Solubility of regular Insulin after 7 days at 2-8° C.

| pH | NaCl concentration (mM) | | | |
|---|---|---|---|---|
| | 50 | 80 | 110 | 140 |
| 0.2% phenol + 0.15% m-cresol formulation | | | | |
| 7.6 | 102.1 | 99.2 | 98.5 | 82.2 |
| 7.4 | 101.8 | 99.2 | 87.8 | 40.6 |
| 7.2 | 101.8 | 92.2 | 37.4 | 18.9 |
| 7.0 | 100.3 | 35.7 | 17.7 | 11.6 |
| 6.8 | 38.4 | 17.1 | 10.2 | 6.5 |
| 6.6 | 26.8 | 8.7 | 6.5 | 5.8 |
| 0.15% phenol + 0.15% m-cresol formulation | | | | |
| 7.6 | 97.2 | 97.1 | 97.1 | 91.7 |
| 7.4 | 96.7 | 97.3 | 94.2 | 57.9 |
| 7.2 | 97.0 | 96.4 | 58.7 | 33.1 |
| 7.0 | 96.7 | 80.8 | 32.9 | 17.1 |
| 6.8 | 66.6 | 24.9 | 17.0 | 10.2 |
| 6.6 | 31.2 | 18.6 | 14.6 | 12.9 |
| 0.2% methylparaben + 0.15% m-cresol formulation | | | | |
| 7.6 | 98.1 | 97.9 | 97.0 | 95.4 |
| 7.4 | 98.1 | 97.7 | 94.6 | 59.1 |
| 7.2 | 98.0 | 90.6 | 47.1 | 32.9 |
| 7.0 | 86.9 | 46.6 | 23.0 | 15.9 |
| 6.8 | 34.1 | 19.0 | 11.4 | 10.2 |
| 6.6 | 15.3 | 9.0 | 7.4 | 5.8 |

TABLE 35

Solubility of Insulin Aspart after 7 days at 2-8° C.

| | NaCl concentration (mM) | | | |
|---|---|---|---|---|
| pH | 50 | 80 | 110 | 140 |
| 0.2% phenol + 0.15% m-cresol formulation | | | | |
| 7.6 | 99.2 | 100.8 | 100.2 | 99.8 |
| 7.4 | 99.2 | 100.6 | 100.0 | 99.7 |
| 7.2 | 99.1 | 100.5 | 100.0 | 99.7 |
| 7.0 | 99.1 | 100.6 | 99.9 | 88.9 |
| 6.8 | 98.8 | 91.8 | 72.8 | 50.9 |
| 6.6 | 91.8 | 59.2 | 58.0 | 39.3 |
| 0.15% phenol + 0.15% m-cresol formulation | | | | |
| 7.6 | 100.1 | 99.7 | 99.4 | 101.1 |
| 7.4 | 100.0 | 99.6 | 99.5 | 101.1 |
| 7.2 | 99.1 | 99.2 | 99.2 | 101.1 |
| 7.0 | 99.7 | 99.3 | 99.3 | 100.2 |
| 6.8 | 99.8 | 97.9 | 97.5 | 60.5 |
| 6.6 | 97.9 | 86.3 | 54.4 | 38.3 |
| 0.2% methylparaben + 0.15% m-cresol formulation | | | | |
| 7.6 | 99.3 | 100.6 | 99.8 | 99.8 |
| 7.4 | 99.1 | 100.5 | 99.6 | 99.6 |
| 7.2 | 99.0 | 100.2 | 99.5 | 101.6 |
| 7.0 | 98.7 | 100.2 | 96.3 | 67.9 |
| 6.8 | 97.2 | 84.1 | 54.2 | 32.2 |
| 6.6 | 57.7 | 32.1 | 21.1 | 14.7 |

B. Follow-Up Study with Reduced M-Cresol Level

Insulin solubility was further evaluated in a simplified follow-up study with a reduced m-cresol level. Four combinations of preservative levels were utilized: 1) 0.1% m-cresol and 0.15% phenol; 2) 0.1% m-cresol and 0.2% phenol; 3) 0.1% m-cresol and 0.15% methylparaben; and 4) 0.1% m-cresol and 0.2% methylparaben. Two pH levels (7.3 and 7.1) and two NaCl concentrations (120 and 100 mM) were evaluated. The remaining formulation components were kept constant at: 120 U/mL regular insulin, 5 µg/mL rHuPH20 (600 U/mL), 20 mM Tris/HCl (Trizma, Sigma, Cat No. T6066), 0.02% Poloxamer 188 (Poloxamer 188, Spectrum, Cat No. P1169), and 0.1 mM $ZnCl_2$ (EMD, Cat No. ZX0065-1). The formulations were prepared and tested as described above.

The results are set forth in Table 36 below. The overall solubility of regular insulin increases slightly in the presence of lower amounts of m-cresol, and additionally, when phenol is replaced with methylparaben.

TABLE 36

Solubility of regular insulin with reduced levels of m-cresol at 2-8° C.

| Formulation # | pH | NaCl (mM) | m-cresol (%) | phenol (%) | methyl-paraben (%) | Insulin Recovery | |
|---|---|---|---|---|---|---|---|
| | | | | | | 1 day | 3 days |
| 1 | 7.3 | 120 | 0.1 | 0.15 | — | 84.15 | 52.13 |
| 2 | 7.3 | 120 | 0.1 | 0.2 | — | 72.75 | 40.78 |
| 3 | 7.3 | 120 | 0.1 | — | 0.15 | 92.88 | 92.68 |
| 4 | 7.3 | 120 | 0.1 | — | 0.2 | 94.76 | 94.80 |
| 5 | 7.1 | 100 | 0.1 | 0.15 | — | 72.60 | 38.87 |
| 6 | 7.1 | 100 | 0.1 | 0.2 | — | 64.86 | 32.69 |
| 7 | 7.1 | 100 | 0.1 | — | 0.15 | 93.87 | 91.99 |
| 8 | 7.1 | 100 | 0.1 | — | 0.2 | 92.32 | 90.59 |

C. Long-Term Effect of pH and NaCl on rHuPH20 and Insulin Stability

In this example, a full factorial study design was employed to determine the effects of pH and NaCl on regular insulin and rHuPH20 solubility in order to identify a condition that maximizes insulin solubility at 2-8° C. and maximizes rHuPH20 stability at room temperature or higher at a high preservative level. The preservative level was set to meet EP-A criteria. Four levels of NaCl concentrations and 4 levels of pH were evaluated generating a total of 16 samples. The samples were evaluated for stability under both short-term accelerated conditions (high temperature) and long-term storage at 2-8° C.

Regular insulin (100 U/mL, prepared as described in Example 1 above, with a final pH of 7.0) and 5 µg/mL rHuPH20 were formulated in a common buffer containing 20 mM Tris/HCl, 0.1 mM $ZnCl_2$, 0.01% Poloxamer 188, 0.15% m-cresol and 0.2% phenol. Solubility was determined by RP-HPLC as described in Example 3 above. Solubility was expressed as relative percent compared to the standard, with 100% being 100 U/mL. rHuPH20 enzymatic activity was assessed as described in Example 2 above. RP-HPLC was used to monitor the total content and purity of rHuPH20 (see Example 3 above). Data was processed by Design Expert 7.0 (StatEase). ANOVA and correlation analyses were performed by JMP 8.0 software.

The results are set forth in Tables 37-42 below. Tables 37-38 set forth the rHuPH20 enzymatic activity and Table 39 sets forth the rHuPH20 percent recovery. Under short-term accelerated conditions, rHuPH20 enzymatic activity was effected by pH, NaCl and storage temperatures, as indicated in Table 37 below. After 1 week storage at 35° C., there was no meaningful rHuPH20 activity remaining. The enzymatic activity after storage at 30° C. was improved compared to 35° C., but the only formulation that retained >375 U/mL had a high NaCl concentration (140 mM) and low pH (7.0). In general, the higher the pH and the lower the salt concentration, the lower the enzymatic activity. At a storage temperature of 25° C. the effect on rHuPH20 enzymatic activity was greatly reduced, although the trends observed for 30° C. remained, especially for formulations having low salt and high pH. A majority of the formulations maintained enzymatic activity above the set criteria of 375 U/mL at the 4 week time point. At 5° C. there was essentially no loss in rHuPH20 enzymatic activity, even after storage for 1 month. This trend continued over 9 months storage at 2-8° C., as seen in Table 38 below. In summary, rHuPH20 maintains enzymatic activity when stored at 25° C. or lower temperature, especially when the NaCl concentration is kept above 80 mM. Stability quickly diminishes at temperatures higher than 25° C. RP-HPLC was used to monitor the total content of rHuPH20 and its purity. As shown in Table 39 below, loss of enzymatic activity is correlated with loss of rHuPH20 content (statistical analysis, $p<0.001$). An analysis of rHuPH20 purity revealed no significant trends or differences in the relative peak area purity values for the rHuPH20 main peak area (data not shown), indicating that the purity is consistent and therefore the loss of activity is due to a loss of total content. Loss of content is likely due to protein unfolding at high preservative concentrations and temperatures, leading to aggregation and precipitation of the rHuPH20.

Tables 40-41 set forth the percent of insulin main peak and percent of insulin recovery after long term storage at 2-8° C. In Table 38, the percent of insulin recovery was based on the sum of the insulin main peak and desamido peak. As is shown in Table 40, the insulin main peak percentage remained high (about 97%) without significant changes, indicating that the loss was not due to insulin chemical or physical degradation, such as deamidation or aggregation. Visual inspection of the vials indicated mixtures of tiny shiny grits or clear crystalline or crystalline-like particles with an occasional cloudy solution. The data in Table 41 summarize insulin content remaining in solution in the formulation at each time point. Insulin recovery as compared to initial conditions is an indication of solubility. Insulin precipitation/crystallization varied depending on the ranges of pH and NaCl concentrations tested. Generally, when the pH was low and the salt concentration high (conditions that favor rHuPH20 activity), the insulin formed crystals very quickly and reached equilibrium conditions in a couple of months. At low salt concentration and high pH, the crystallization was slow and most of the insulin molecules remained in solution at 9 months. The statistical analyses (see Table 42 below) of the insulin recovery data show that pH, NaCl, time, pH*NaCl and NaCl*time all significantly influence insulin solubility. These results indicated that insulin solubility for extended time periods is dependent on high pH (higher than 7.4) and low NaCl (less than 80 mM), in direct contrast to conditions that maintain rHuPH20 enzymatic activity.

TABLE 37 rHuPH20 enzymatic activity

| # | NaCl, mM | pH | T = 0 | 35° C. 1W | 30° C. 1W | 30° C. 2W | 25° C. 1W | 25° C. 2W | 5° C. 1M | 5° C. 2W | 5° C. 1M |
|---|---|---|---|---|---|---|---|---|---|---|---|
| 1 | 140 | 7.6 | 588 | — | 244 | 133 | 545 | 528 | 461 | 613 | 597 |
| 2 | 140 | 7.4 | 593 | 15 | 322 | 238 | 557 | 494 | 496 | 572 | 594 |
| 3 | 140 | 7.2 | 583 | 31 | 370 | 300 | 585 | 530 | 514 | 563 | 592 |
| 4 | 140 | 7.0 | 576 | 84 | 418 | 387 | 579 | 507 | 513 | 569 | 586 |
| 5 | 110 | 7.6 | 577 | — | 163 | 73 | 525 | 496 | 412 | 569 | 582 |
| 6 | 110 | 7.4 | 574 | — | 256 | 159 | 541 | 489 | 449 | 655 | 592 |
| 7 | 110 | 7.2 | 581 | 14 | 327 | 257 | 565 | 501 | 505 | 574 | 581 |
| 8 | 110 | 7.0 | 580 | 49 | 376 | 304 | 576 | 512 | 512 | 564 | 588 |
| 9 | 80 | 7.6 | 599 | 9 | 152 | 82 | 498 | 430 | 385 | 540 | 584 |
| 10 | 80 | 7.4 | 574 | — | 91 | 17 | 451 | 401 | 290 | 613 | 557 |
| 11 | 80 | 7.2 | 544 | — | 230 | 133 | 522 | 444 | 416 | 536 | 548 |
| 12 | 80 | 7.0 | 549 | — | 283 | 199 | 518 | 448 | 435 | 536 | 548 |
| 13 | 50 | 7.6 | 526 | — | 38 | — | 361 | 296 | 178 | 518 | 514 |
| 14 | 50 | 7.4 | 535 | — | 47 | 5 | 426 | 329 | 265 | 521 | 525 |
| 15 | 50 | 7.2 | 529 | 14 | 115 | 51 | 481 | 371 | 324 | 518 | 544 |
| 16 | 50 | 7.0 | 522 | — | 172 | 87 | 507 | 405 | 339 | 574 | 543 |

—Below level of detection

TABLE 38 rHuPH20 enzymatic activity after long term storage at 2-8° C.

| pH | NaCl concentration (mM) | | | |
|---|---|---|---|---|
| | 50 | 80 | 110 | 140 |
| 5 Months | | | | |
| 7.6 | 508.0571 | 546.4209 | 581.6326 | 594.6197 |
| 7.4 | 526.6628 | 564.7769 | 618.3856 | 585.9813 |
| 7.2 | 481.6035 | 566.2521 | 593.2027 | 585.9948 |
| 7.0 | 494.4796 | 575.3274 | 615.3546 | 582.4274 |
| 9 Months | | | | |
| 7.6 | 464.8964 | 515.3382 | 531.9202 | 523.5385 |
| 7.4 | 466.1871 | 509.9032 | 560.4847 | 542.4534 |
| 7.2 | 451.8324 | 518.0740 | 553.1847 | 536.7846 |
| 7.0 | 436.5115 | 513.9692 | 551.0218 | 554.6513 |

TABLE 39

Percent recovery rHuPH20

| # | NaCl, mM | pH | % recovery rHuPH20* | | | | |
|---|---|---|---|---|---|---|---|
| | | | 35° C., 1W | 30° C., 2W | 25° C., 4W | 5° C., 1M | 5° C., 9M |
| 1 | 140 | 7.6 | 41.90 | 52.70 | 70.78 | 101.78 | 94.05 |
| 2 | 140 | 7.4 | 42.91 | 67.13 | 83.24 | 98.45 | 93.36 |
| 3 | 140 | 7.2 | 49.99 | 68.94 | 89.84 | 102.18 | 102.07 |
| 4 | 140 | 7.0 | 49.55 | 70.64 | 91.10 | 97.59 | 101.54 |
| 5 | 110 | 7.6 | 37.50 | 53.04 | 82.95 | 96.95 | 92.45 |
| 6 | 110 | 7.4 | 45.20 | 58.19 | 88.46 | 107.24 | 97.80 |
| 7 | 110 | 7.2 | 42.96 | 59.21 | 86.68 | 93.10 | 108.11 |
| 8 | 110 | 7.0 | 45.31 | 64.58 | 89.49 | 102.01 | 92.18 |
| 9 | 80 | 7.6 | 42.91 | 56.60 | 73.76 | 90.92 | 92.18 |
| 10 | 80 | 7.4 | 34.26 | 53.21 | 73.82 | 88.45 | 98.33 |
| 11 | 80 | 7.2 | 38.33 | 59.21 | 82.78 | 87.93 | 95.23 |
| 12 | 80 | 7.0 | 37.83 | 56.55 | 78.93 | 97.18 | 101.16 |
| 13 | 50 | 7.6 | 34.87 | 49.07 | 42.13 | 87.93 | 83.47 |
| 14 | 50 | 7.4 | 40.29 | 52.53 | 60.91 | 92.41 | 90.85 |
| 15 | 50 | 7.2 | 39.56 | 52.47 | 69.92 | 87.76 | 91.54 |
| 16 | 50 | 7.0 | 38.50 | 50.55 | 72.96 | 97.30 | 93.52 |

*% recovery was based on total measure peak area in comparison to a known reference standard.

TABLE 40

Percent of insulin main peak after long term storage at 2-8° C.

| pH | Time (months) | | | | | | |
|---|---|---|---|---|---|---|---|
| | 0 | 0.25 | 0.5 | 1 | 3 | 5 | 9 |
| 140 mM NaCl | | | | | | | |
| 7.6 | 97.64 | 97.61 | 97.41 | 97.51 | 97.35 | 97.56 | 97.07 |
| 7.4 | 97.64 | 97.57 | 97.33 | 97.23 | 97.38 | 97.73 | 96.10 |
| 7.2 | 97.56 | 97.37 | 96.98 | 96.62 | 96.60 | 98.04 | 95.49 |
| 7.0 | 97.65 | 97.15 | 97.05 | 96.39 | 96.16 | 97.97 | 95.17 |
| 110 mM NaCl | | | | | | | |
| 7.6 | 97.58 | 97.57 | 97.60 | 97.52 | 97.42 | 97.61 | 97.31 |
| 7.4 | 97.65 | 97.58 | 97.39 | 97.36 | 97.36 | 97.79 | 96.91 |
| 7.2 | 97.62 | 97.46 | 97.35 | 97.03 | 97.49 | 97.61 | 95.91 |
| 7.0 | 97.64 | 97.31 | 97.57 | 96.64 | 96.10 | 97.79 | 95.03 |
| 80 mM NaCl | | | | | | | |
| 7.6 | 97.63 | 97.62 | 97.52 | 97.37 | 97.64 | 97.67 | 97.31 |
| 7.4 | 97.56 | 97.61 | 97.51 | 97.43 | 97.43 | 97.75 | 97.29 |
| 7.2 | 97.57 | 97.59 | 97.30 | 97.45 | 97.34 | 97.64 | 97.00 |
| 7.0 | 97.65 | 97.50 | 97.30 | 97.20 | 97.04 | 97.81 | 96.18 |
| 50 mM NaCl | | | | | | | |
| 7.6 | 97.65 | 97.58 | 97.33 | 97.44 | 97.35 | 97.66 | 97.34 |
| 7.4 | 97.58 | 97.54 | 97.48 | 97.47 | 97.45 | 97.74 | 97.27 |
| 7.2 | 97.64 | 97.59 | 97.56 | 97.46 | 97.47 | 97.75 | 97.27 |
| 7.0 | 97.64 | 97.59 | 97.50 | 97.44 | 97.24 | 97.73 | 97.20 |

TABLE 41

Percent of insulin recovery after long term storage at 2-8° C.

| pH | Time (months) | | | | | | |
|---|---|---|---|---|---|---|---|
| | 0 | 0.25 | 0.5 | 1 | 3 | 5 | 9 |
| 140 mM NaCl | | | | | | | |
| 7.6 | 95.73 | 95.53 | 94.46 | 87.46 | 64.62 | 67.99 | 46.20 |
| 7.4 | 95.73 | 83.13 | 50.31 | 39.27 | 37.45 | 34.80 | 27.30 |
| 7.2 | 95.82 | 37.37 | 25.12 | 23.62 | 19.03 | 17.15 | 15.99 |
| 7.0 | 95.78 | 21.70 | 15.04 | 13.80 | 11.11 | 11.14 | 11.13 |
| 110 mM NaCl | | | | | | | |
| 7.6 | 95.47 | 96.74 | 96.40 | 96.35 | 95.89 | 95.50 | 84.82 |
| 7.4 | 96.69 | 96.86 | 93.50 | 74.63 | 63.68 | 68.64 | 43.83 |

TABLE 41-continued

Percent of insulin recovery after long term storage at 2-8° C.

| | Time (months) | | | | | | |
|---|---|---|---|---|---|---|---|
| pH | 0 | 0.25 | 0.5 | 1 | 3 | 5 | 9 |
| 7.2 | 96.45 | 66.09 | 39.64 | 32.94 | 58.68 | 28.02 | 23.68 |
| 7.0 | 96.35 | 31.18 | 19.52 | 18.50 | 15.05 | 14.72 | 14.23 |
| 80 mM NaCl | | | | | | | |
| 7.6 | 95.48 | 95.96 | 96.22 | 96.34 | 95.43 | 96.17 | 96.91 |
| 7.4 | 96.34 | 96.51 | 96.49 | 96.64 | 96.05 | 96.25 | 98.62 |
| 7.2 | 96.50 | 96.06 | 95.81 | 86.34 | 60.90 | 61.48 | 50.74 |
| 7.0 | 96.36 | 64.78 | 40.76 | 35.90 | 33.47 | 32.72 | 29.34 |
| 50 mM NaCl | | | | | | | |
| 7.6 | 95.66 | 96.72 | 97.02 | 96.38 | 96.21 | 96.71 | 98.74 |
| 7.4 | 96.74 | 96.44 | 96.36 | 95.89 | 95.90 | 96.58 | 98.78 |
| 7.2 | 96.68 | 95.95 | 95.80 | 95.42 | 95.64 | 96.28 | 98.59 |
| 7.0 | 96.41 | 95.91 | 95.12 | 93.26 | 81.51 | 88.84 | 72.51 |

TABLE 42

Statistical Analyses

Analysis of Variance

| Source | DF | Sum of Squares | Mean Square | F Ratio |
|---|---|---|---|---|
| Model | 6 | 82776.03 | 13796.0 | 51.2972 |
| Error | 105 | 28239.00 | 268.9 | Prob > F |
| C. Total | 111 | 111015.02 | | <.0001* |

Effect Tests

| Source | Nparm | DF | Sum of Squares | F Ratio | Prob > F |
|---|---|---|---|---|---|
| pH | 1 | 1 | 30142.891 | 112.0792 | <.0001* |
| NaCl | 1 | 1 | 35065.510 | 130.3828 | <.0001* |
| pH*NaCl | 1 | 1 | 4786.627 | 17.7979 | <.0001* |
| Time | 1 | 1 | 9068.524 | 33.7192 | <.0001* |
| pH*Time | 1 | 1 | 752.462 | 2.7979 | 0.0974 |
| NaCl*Time | 1 | 1 | 2960.012 | 11.0061 | 0.0012* |

*significant

Example 10

Insulin Analog Formulation Development:
Stabilizer Screening for Insulin Formulated with rHuPH20

Preservatives protect against potential microbial contamination of insulin that is possible due to multiple dosing. Typical preservatives are m-cresol, phenol and parabens. These preservatives serve as antimicrobials but also serve to stabilize higher order structures of insulin. Phenolic preservatives have been shown to decrease the stability of rHuPH20 (see Example 7). In this example, various stabilizers were screened for their ability to prevent the degradation of rHuPH20 in the presence of phenolic preservatives while maintaining insulin/insulin analog stability. Stabilizers that were screened included commonly used pharmaceutical excipients, including amino acids and their derivatives, salts and buffer species, polyols and others compounds. Stability was determined by rHuPH20 enzymatic activity and insulin solubility. Specific stabilizing effects included prevention of adsorptive loss and/or oxidation of rHuPH20 and general stabilizing effects as measured by rHuPH20 enzymatic activity.

A. Effect of Various Surfactants on rHuPH20 Enzymatic Activity

Several common surfactants, namely polysorbate 80 (PS80), polysorbate 20 (PS20) and poloxamer 188 (Pluronic® F68) were screened for their ability to preserve rHuPH20 formulations. All formulations contained 100 µg/mL rHuPH20 (12,000 U) and 150 mM NaCl at pH 6.5. The formulations varied in the surfactant and surfactant concentration and the buffer (either histidine or phosphate). The formulations were subjected to agitation at 35° C. for 10 days, with samples analyzed for rHuPH20 activity at days 3 and 10. rHuPH20 enzymatic activity was determined as described in Example 2 above. rHuPH20 stability was determined by measuring the oxidation peak of rHuPH20 by RP-HPLC and by size exclusion chromatography (SEC) (see Examples 3 and 4 above).

The formulations and results of rHuPH20 enzymatic activity are set forth in Table 43 below. An ANOVA analysis of rHuPH20 oxidation as measured by RP-HPLC shows no significant difference in enzymatic activity with respect to surfactant type, surfactant concentration, buffer or agitation time (F=0.6832, p=0.6397). Additionally, SEC results did not show detectable differences in the sizes of the main peaks (data not shown).

The results of rHuPH20 oxidation are set forth in Table 44 below. The results show that the oxidation peak area increased with increasing levels of surfactant and time of agitation. Polysorbate 20 is known to contain measurable amounts of peroxide activity (see, e.g., Donbrow et al., (1978) *J. Pharm Sci.* 67(12):1676-1681, or Kibbe, A. H., ed. (2000) Handbook of Pharmaceutical Excipients. 3rd Edition, American Pharmaceutical Association & Pharmaceutical Press: Washington, D.C. & London, UK). In this study, the polysorbate 20 used was an old lot which resulted in high oxidation of rHuPH20; in contrast, Poloxamer 188 caused only trace amounts of oxidation. The multivariate analysis of variance indicated that the agitation time as well as surfactant type and concentration effected the oxidation level of rHuPH20 (see Table 45 below). Also, significant were interaction terms including surfactant versus concentration, surfactant versus time and concentration versus time.

Based on these results, it is clear that the addition of surfactant in rHuPH20 formulations could effectively reduce the loss of rHuPH20, presumably due to preventing adsorptive loss and possible denaturation at the air-water interface. However, a potential drawback from the addition of surfactant is that it may increase oxidation for rHuPH20.

TABLE 43

Effect of PS80, PS20 and F68 on rHuPH20 enzymatic activity

| | | | Enzyme activity (U/mL) | |
|---|---|---|---|---|
| # | Surfactant, conc (% w/v) | Buffer | Agitated 3 days | Agitated 10 days |
| 1 | PS80, 0.1% | 50 mM histidine | 11,515 | 11,444 |
| 2 | PS80, 0.01% | 50 mM histidine | 10,370 | 10,358 |
| 3 | PS80, 0.001% | 50 mM histidine | 9,758 | 9,850 |
| 4 | PS20, 0.1% | 50 mM histidine | 9,993 | 7,990 |
| 5 | PS20, 0.01% | 50 mM histidine | 10,566 | 10,448 |
| 6 | PS20, 0.001% | 50 mM histidine | 8,644 | 8,488 |
| 7 | F68, 0.1% | 50 mM histidine | 10,460 | 9,580 |
| 8 | F68, 0.01% | 50 mM histidine | 10,537 | 10,064 |
| 9 | F68, 0.001% | 50 mM histidine | 9,148 | 8,811 |
| 10 | PS80, 0.1% | 50 mM phosphate | 10,473 | 7,459 |
| 11 | PS80, 0.01% | 50 mM phosphate | 10,590 | 10,919 |
| 12 | PS80, 0.001% | 50 mM phosphate | 9,233 | 9,858 |
| 13 | PS20, 0.1% | 50 mM phosphate | 9,839 | 9,004 |

TABLE 43-continued

Effect of PS80, PS20 and F68 on rHuPH20 enzymatic activity

| # | Surfactant, conc (% w/v) | Buffer | Enzyme activity (U/mL) Agitated 3 days | Agitated 10 days |
|---|---|---|---|---|
| 14 | PS20, 0.01% | 50 mM phosphate | 10,659 | 11,241 |
| 15 | PS20, 0.001% | 50 mM phosphate | 9,161 | 9,770 |
| 16 | F68, 0.1% | 50 mM phosphate | 11,274 | 11,197 |
| 17 | F68, 0.01% | 50 mM phosphate | 10,669 | 10,459 |
| 18 | F68, 0.001% | 50 mM phosphate | 9,605 | 9,655 |

TABLE 44

Effect of PS80, PS20 and F68 on rHuPH20 oxidation

| # | Surfactant, conc (% w/v) | Buffer | % Oxidation Peak Agitated 3 days | Agitated 10 days |
|---|---|---|---|---|
| 1 | PS80, 0.1% | 50 mM histidine | 6.89 | 8.5 |
| 2 | PS80, 0.01% | 50 mM histidine | 4.35 | 4.89 |
| 3 | PS80, 0.001% | 50 mM histidine | 3.82 | 3.94 |
| 4 | PS20, 0.1% | 50 mM histidine | 44.13 | 74.39 |
| 5 | PS20, 0.01% | 50 mM histidine | 10.01 | 14.21 |
| 6 | PS20, 0.001% | 50 mM histidine | 4.56 | 4.91 |
| 7 | F68, 0.1% | 50 mM histidine | 4.52 | 17.63 |
| 8 | F68, 0.01% | 50 mM histidine | 3.83 | 5.38 |
| 9 | F68, 0.001% | 50 mM histidine | 3.79 | 4.31 |
| 10 | PS80, 0.1% | 50 mM phosphate | 5.41 | 12.40 |
| 11 | PS80, 0.01% | 50 mM phosphate | 3.83 | 5.01 |
| 12 | PS80, 0.001% | 50 mM phosphate | 3.41 | 4.62 |
| 13 | PS20, 0.1% | 50 mM phosphate | 43.79 | 65.34 |
| 14 | PS20, 0.01% | 50 mM phosphate | 10.32 | 12.48 |
| 15 | PS20, 0.001% | 50 mM phosphate | 4.25 | 5.15 |
| 16 | F68, 0.1% | 50 mM phosphate | 6.11 | 6.29 |
| 17 | F68, 0.01% | 50 mM phosphate | 3.80 | 4.72 |
| 18 | F68, 0.001% | 50 mM phosphate | 3.61 | 4.21 |

TABLE 45

Statistical Analyses

Summary of Fit

| | |
|---|---|
| RSquare | 0.975911 |
| RSquare Adj | 0.959852 |
| Root Mean Square Error | 3.423151 |
| Mean of Response | 11.91222 |
| Observations (or Sum Wgts) | 36 |

Analysis of Variance

| Source | DF | Sum of Squares | Mean Square | F Ratio |
|---|---|---|---|---|
| Model | 14 | 9969.264 | 712.090 | 60.7691 |
| Error | 21 | 246.077 | 11.718 | Prob > F |
| C. Total | 35 | 10215.341 | | <.0001* |

Effect Tests

| Source | Nparm | DF | Sum of Squares | F Ratio | Prob > F |
|---|---|---|---|---|---|
| surfactant | 2 | 2 | 909.4801 | 38.8071 | <.0001* |
| buffer | 1 | 1 | 0.1152 | 0.0098 | 0.9220 |
| conc | 1 | 1 | 741.1067 | 63.2454 | <.0001* |
| time | 1 | 1 | 214.5248 | 18.3074 | 0.0003* |
| surfactant*buffer | 2 | 2 | 20.3784 | 0.8695 | 0.4337 |
| surfactant*conc | 2 | 2 | 3557.3392 | 151.7900 | <.0001* |
| surfactant*time | 2 | 2 | 114.0738 | 4.8675 | 0.0183* |
| buffer*conc | 1 | 1 | 14.8438 | 1.2668 | 0.2731 |

TABLE 45-continued

Statistical Analyses

| | | | | | |
|---|---|---|---|---|---|
| buffer*time | 1 | 1 | 10.4329 | 0.8903 | 0.3561 |
| conc*time | 1 | 1 | 248.4121 | 21.1993 | 0.0002* |

*Significant

B. Methionine

1. Effect of Methionine on Preventing rHuPH20 Oxidation rHuPH20 has two potential oxidation sites: Met458 and Met35. The "ox-1" peak corresponds to Met458 and is the main oxidation peak when assayed by RP-HPLC. The "ox-2" peak contains both methionine oxidations. Methionine oxidation can be prevented by addition of free methionine as a scavenger to react with potential oxidative compounds.

a. rHuPH20 Formulations

In this study, the effect of the addition of free methionine on the oxidation of rHuPH20 in the presence of polysorbate 20, polysorbate 80 and/or Poloxamer 188 was evaluated. Each formulation contained 5 µg/mL rHuPH20, 0.02% designated surfactant, 50 mM phosphate, pH 6.5, 150 mM NaCl and methionine (from 0 to 50 mM). The samples were incubated at 30° C. for 72 hours and examined by RP-HPLC as set forth in Example 3 above. The results are set forth in Table 46 below. The statistical analyses are set forth in Table 47 below. The results indicated that methionine prevents the oxidation of rHuPH20 at a concentration of 2 mM.

TABLE 46

Effect of methionine on the oxidation of rHuPH20

| Methionine (mM) | % of Oxidation Peak 1 Poloxamer 188 | Polysorbate 20 | Polysorbate 80 |
|---|---|---|---|
| 0 | 3.98 | 4.01 | 4.01 |
| 2 | 3.39 | 3.43 | 3.50 |
| 10 | 3.36 | 3.37 | 3.44 |
| 50 | 3.34 | 3.38 | 3.34 |

TABLE 47

Statistical Analyses

Summary of Fit

| | |
|---|---|
| RSquare | 0.993397 |
| RSquare Adj | 0.987894 |
| Root Mean Square Error | 0.030551 |
| Mean of Response | 3.545833 |
| Observations (or Sum Wgts) | 12 |

Analysis of Variance

| Source | DF | Sum of Squares | Mean Square | F Ratio |
|---|---|---|---|---|
| Model | 5 | 0.84249167 | 0.168498 | 180.5339 |
| Error | 6 | 0.00560000 | 0.000933 | Prob > F |
| C. Total | 11 | 0.84809167 | | <.0001* |

TABLE 47-continued

Statistical Analyses

Effect Tests

| Source | Nparm | DF | Sum of Squares | F Ratio | Prob > F |
|---|---|---|---|---|---|
| Surfactant | 2 | 2 | 0.00606667 | 3.2500 | 0.1106 |
| Met | 3 | 3 | 0.83642500 | 298.7232 | <.0001* |

*Significant b. rHuPH20/Insulin Formulations

Methionine was tested for its ability to prevent rHuPH20 oxidation in rHuPH20/insulin formulations. The formulations contained 100 U/mL insulin (Organon Insulin API, Recombinant Human insulin SIHR 143, the stock solution was prepared as described in Example 1), 5 μg/mL rHuPH20, 20 mM tris/HCl, pH 7.4, 80 mM NaCl, 0.03% poloxamer 188, 0.1% Phenol and 0.1% m-cresol in the presence or absence of 40 mM methionine. The formulations were incubated at 30° C. for 5 weeks to evaluate the oxidation peak of rHuPH20. The results showed that the ox-1 peak was significantly smaller as measured by RP-HPLC in formulations that contained methionine as compared to formulations that did not contain methionine.

2. Methionine as a General Stabilizer

Methionine was further evaluated for its ability to prevent loss of rHuPH20 enzymatic activity at higher temperature and preservative content. A designed of experiment (DOE) response surface methodology study (RSM) was conducted to evaluate the effect of methionine on rHuPH20 enzymatic activity at different levels of NaCl concentration and pH. The basic formulations contained 100 U/mL insulin (Organon Insulin API, Recombinant Human insulin SIHR 143, the stock solution was prepared as described in Example 1), 5 μg/mL rHuPH20, 20 mM Tris/HCl, 0.1% m-cresol, 0.1% phenol and 0.01% poloxamer 188. The methionine concentration range varied between 40 and 80 mM, the NaCl concentration range varied between 70 and 110 mM and the pH range was between 7.2 and 7.6. The formulations were incubated at either 30° C. for 4 weeks or 35° C. for 5 days and rHuPH20 enzymatic activity was determined as set forth in Example 2 above.

The data is set forth in Table 48 below. The statistical analyses of the data are set forth in Tables 49-50 below. The data shows that the concentration of NaCl has a significant effect on the stability of rHuPH20 at both 30° C. and 35° C. pH has a significant effect at 35° C. Methionine did not show stabilizing effect on rHuPH20 between 40 and 80 mM. A follow up study indicated that the results were the same in the presence or absence of methionine. Formulations with a starting rHuPH20 enzymatic activity of 650 U/mL dropped to 525 and 522 U/mL for 1 and 20 mM methionine, respectively, after storage at 30° C. for one month. Thus, methionine acts as an anti-oxidant, but does not improve the overall stability of rHuPH20 against preservative and thermal stress.

TABLE 48

Effects of methionine, NaCl and pH on rHuPH20 activity in insulin-PH20 formulations

| | | | rHuPH20 activity (U/mL) | |
|---|---|---|---|---|
| Met (mM) | NaCl (mM) | pH | 30° C., 4 W | 35° C., 5 D |
| 40 | 110 | 7.4 | 559 | 462 |
| 60 | 110 | 7.2 | 558 | 518 |
| 60 | 90 | 7.4 | 551 | 432 |
| 40 | 90 | 7.2 | 539 | 459 |
| 60 | 90 | 7.4 | 530 | 418 |
| 80 | 110 | 7.4 | 556 | 475 |
| 40 | 70 | 7.4 | 456 | 303 |
| 40 | 90 | 7.6 | 508 | 349 |
| 60 | 110 | 7.6 | 552 | 430 |
| 60 | 70 | 7.6 | 444 | 258 |
| 60 | 90 | 7.4 | 522 | 415 |
| 60 | 90 | 7.4 | 525 | 426 |
| 60 | 70 | 7.2 | 455 | 414 |
| 80 | 90 | 7.6 | 467 | 326 |
| 80 | 90 | 7.2 | 503 | 428 |
| 80 | 70 | 7.4 | 452 | 341 |
| 60 | 90 | 7.4 | 500 | 401 |

TABLE 49

Response activity of HuPH20 measured after stored at 30° C. for 2 weeks

Summary of Fit

| | |
|---|---|
| RSquare | 0.91826 |
| RSquare Adj | 0.813165 |
| Root Mean Square Error | 17.88843 |
| Mean of Response | 510.4541 |
| Observations (or Sum Wgts) | 17 |

Analysis of Variance

| Source | DF | Sum of Squares | Mean Square | F Ratio |
|---|---|---|---|---|
| Model | 9 | 25163.516 | 2795.95 | 8.7374 |
| Error | 7 | 2239.972 | 320.00 | Prob > F |
| C. Total | 16 | 27403.488 | | 0.0046* |

Effect Tests

| Source | Nparm | DF | Sum of Squares | F Ratio | Prob > F |
|---|---|---|---|---|---|
| Met | 1 | 1 | 884.795 | 2.7650 | 0.1403 |
| NaCl | 1 | 1 | 21696.424 | 67.8022 | <.0001* |
| pH | 1 | 1 | 882.210 | 2.7569 | 0.1408 |
| Met*Met | 1 | 1 | 349.423 | 1.0920 | 0.3308 |
| Met*NaCl | 1 | 1 | 0.936 | 0.0029 | 0.9584 |
| NaCl*NaCl | 1 | 1 | 487.419 | 1.5232 | 0.2570 |
| Met*pH | 1 | 1 | 6.812 | 0.0213 | 0.8881 |
| NaCl*pH | 1 | 1 | 7.784 | 0.0243 | 0.8805 |
| pH*pH | 1 | 1 | 674.368 | 2.1074 | 0.1899 |

*Significant

TABLE 50

Response activity of HuPH20 measured after stored at 35° C. for 5 days

Summary of Fit

| | |
|---|---|
| RSquare | 0.970969 |
| RSquare Adj | 0.933643 |
| Root Mean Square Error | 17.2642 |
| Mean of Response | 403.3303 |
| Observations (or Sum Wgts) | 17 |

TABLE 50-continued

Response activity of HuPH20 measured after stored at 35° C. for 5 days

Analysis of Variance

| Source | DF | Sum of Squares | Mean Square | F Ratio |
|---|---|---|---|---|
| Model | 9 | 69779.522 | 7753.28 | 26.0131 |
| Error | 7 | 2086.367 | 298.05 | Prob > F |
| C. Total | 16 | 71865.889 | | 0.0001* |

Effect Tests

| Source | Nparm | DF | Sum of Squares | F Ratio | Prob > F |
|---|---|---|---|---|---|
| Met | 1 | 1 | 1.347 | 0.0045 | 0.9483 |
| NaCl | 1 | 1 | 40555.093 | 136.0670 | <.0001* |
| pH | 1 | 1 | 25833.100 | 86.6730 | <.0001* |
| Met*Met | 1 | 1 | 1473.541 | 4.9439 | 0.0616 |
| Met*NaCl | 1 | 1 | 146.858 | 0.4927 | 0.5054 |
| NaCl*NaCl | 1 | 1 | 84.069 | 0.2821 | 0.6118 |
| Met*pH | 1 | 1 | 14.175 | 0.0476 | 0.8336 |
| NaCl*pH | 1 | 1 | 1176.764 | 3.9482 | 0.0873 |
| pH*pH | 1 | 1 | 345.281 | 1.1585 | 0.3175 |

*Significant

C. Screening of Potential Stabilizers for rHuPH20/Insulin Formulations

Various compounds were screened for their ability to act as protein stabilizers in the rHuPH20/insulin formulations. The excipients included amino acids and their derivatives, amines, polyols, salts and buffers and other compounds (see Table 51 below). Each compound was screened, typically at two concentrations, for its effect on rHuPH20 enzymatic activity and insulin solubility. The basic formulation typically contained 100 U/mL insulin/insulin analog, 5 μg/mL rHuPH20, 20 mM Tris/HCl, 0.15% m-cresol and 0.2% phenol at a pH 7.3±0.1. Formulations that contained 100-140 mM NaCl were used as reference formulations and the potential stabilizers replaced all or part of the NaCl in the formulations. rHuPH20 enzymatic activity was measured as described in Example 2 above on samples incubated at 30° C. for about one week. Insulin solubility was evaluated by RP-HPLC (see Example 3 above) on samples stored at 5° C.

The results are set forth in Table 51 below. The evaluation was semi-quantitative in comparison with NaCl. A majority of the compounds tested had no effect on insulin solubility with the remaining causing a decrease in insulin solubility. Previous data (see Examples 8-9) indicated that pH and salt, two conditions that can potentially influence the charge of the protein in solution, influence insulin solubility. In the current screen, molecules or compounds containing divalent cations ($Mg^{2+}$ (magnesium chloride) and $SO_4^{2-}$ (sodium sulfate) and Lys-Lys caused severe precipitation of insulin. It appears a charge repulsing mechanism might be important for keeping insulin molecules from interacting with each other. Lys-Lys, magnesium chloride and hyaluronic acid oligomers (HA, 4-16 mers) were identified as molecules that stabilized rHuPH20 more than NaCl. Due to the fact that both Lys-Lys and magnesium chloride decreased insulin solubility, these molecules were not considered viable stabilizers at high concentrations. Reducing the concentration of Lys-Lys will reduce its impact on solubility of insulin.

TABLE 51

Summary of rHuPH20/insulin stabilizer screening

| Category | Compound name | Effect on rHuPH20 enzymatic activity | Effect on insulin solubility |
|---|---|---|---|
| Amino acid, derivative and amines | L-arginine | Similar to NaCl | Significantly reduced solubility; cause severe precipitation |
| | Glutamine | No effect | No effect |
| | Glycine | No effect | No effect |
| | Lysine | No effect | No effect |
| | Methionine | No effect | No effect |
| | Proline | No effect | No effect |
| | Lys-Lys | Strong stabilizer | Reduced solubility |
| | Gly-Gly | No effect | No effect |
| | Trimethylamine oxide (TMAO) | No effect | No effect |
| | Betaine | No effect | No effect |
| Polyols | glycerol | No effect | No/slight effect; might slightly defer crystal formation |
| | sorbitol | No effect | No/slight effect; might slightly defer crystal formation |
| | Mannitol | No effect | No/slight effect; might slightly defer crystal formation |
| | Inositol | No effect | No effect |
| | Sucrose | No effect | No/slight effect; might slightly defer crystal formation |
| | Trehalose | No effect | No/slight effect; might slightly defer crystal formation |
| Salts and buffers | Magnesium chloride | Effective stabilizer | Precipitation |
| | Sodium sulfate | No effect | Increased precipitation compared to NaCl |
| | Tris (100 mM) | No effect | No effect |
| | Sodium Benzoate | No effect | Reduced precipitation compared to NaCl |
| Others | Hyaluronic acid (HA) oligomers (4-16mers) | Effective stabilizer | No effect |
| | Human serum albumin | No effect | No effect |
| | Phenyl butyric acid | No effect | No effect |
| | Taurocholate | No effect - may be destabilizing | No effect |
| | PVP | Unclear | No effect |

D. Effect of HA Oligomers on rHuPH20/Insulin Formulations

HA oligomers were examined further for their ability to stabilize the rHuPH20/insulin formulations. HA oligomers are the substrate/product of the rHuPH20 enzymatic reaction with hyaluronan, and as such could possibly bind to the enzyme active site thereby causing the stabilizing effect. A designed of experiment (DOE) study was performed to investigate the effects of pH, NaCl concentration and HA oligomer concentration on overall rHuPH20/insulin stability.

The basic formulation contained 3.75 mg/mL insulin (Organon Insulin API, Recombinant Human insulin SIHR 143, the stock solution was prepared as described in Example 1), 5 μg/mL rHuPH20, 15 mM Tris/HCl, 0.01% $ZnCl_2$, 0.01% poloxamer 188, 0.15% phenol and 0.15% m-cresol. A total of 17 samples were evaluated, with three different pH levels (7.1, 7.3 and 7.5), three NaCl concentrations (50, 75 and 100 mM) and three HA oligomer concentrations (1, 5.5 and 10 mg/mL). rHuPH20 enzyme activity was measured on samples incubated at 30° C. for 1 week or on samples stored at 2-8° C. for 9 months. rHuPH20 oxidation was measured by RP-HPLC on samples stored at 5° C. for 9 months. Insulin content was measured by RP-HPLC for samples stored at 2-8° C. for 9 months.

The formulations and results are set forth in Table 52 below. Insulin content is expressed as % recovery to a USP reference standard. Percent (%) rHuPH20 oxidation peak area is a sum of the ox-1 (major) and ox-2 (minor) peaks. Statistical analyses are set forth in Table 53 below. As shown in Table 53, HA and NaCl concentration both had a significant effect on rHuPH20 enzymatic activity when measured after incubation at 30° C. for 1 week. As the concentrations of NaCl and HA increased, the rHuPH20 enzymatic activity increased as well. This was particularly true when both excipient concentrations were higher, indicating a significant interaction between the two factors (see Table 53, P=0.0150).

TABLE 52

Effect of HA, pH and NaCl on rHuPH20 activity and insulin solubility

| Run # | pH | HA, mg/mL | NaCl, mM | Enzyme activity (U/mL) 30° C., 1 week | Insulin content | % rHuPH20 oxidation peak area | Enzyme Activity (U/mL) 2-8° C., 9 months |
|---|---|---|---|---|---|---|---|
| 1 | 7.5 | 1 | 75 | 254 | 92.08 | 27.09 | 574 |
| 2 | 7.1 | 1 | 75 | 341 | 52.38 | 26.43 | 576 |
| 3 | 7.3 | 10 | 50 | 267 | 91.58 | 75.03 | 515 |
| 4 | 7.3 | 1 | 50 | 173 | 92.08 | 29.00 | 562 |
| 5 | 7.3 | 1 | 100 | 136 | 45.33 | 30.64 | 531 |
| 6 | 7.1 | 5.5 | 100 | 407 | 21.99 | 55.72 | 521 |
| 7 | 7.3 | 5.5 | 75 | 273 | 89.07 | 58.19 | 523 |
| 8 | 7.3 | 5.5 | 75 | 296 | 85.73 | 55.63 | 506 |
| 9 | 7.3 | 5.5 | 75 | 257 | 87.99 | 58.29 | 504 |
| 10 | 7.1 | 5.5 | 50 | 363 | 82.41 | 55.54 | 524 |
| 11 | 7.5 | 10 | 75 | 389 | 91.16 | 70.57 | 495 |
| 12 | 7.3 | 5.5 | 75 | 357 | 87.63 | 58.61 | 505 |
| 13 | 7.3 | 10 | 100 | 537 | 43.57 | 72.43 | 521 |
| 14 | 7.1 | 10 | 75 | 510 | 38.06 | 72.09 | 494 |
| 15 | 7.3 | 5.5 | 75 | 391 | 86.17 | 56.13 | 510 |
| 16 | 7.5 | 5.5 | 50 | 313 | 91.68 | 52.36 | 489 |
| 17 | 7.5 | 5.5 | 100 | 424 | 89.91 | 53.63 | 478 |

TABLE 53

Statistical analyses of the DOE study on HA, pH, and NaCl effect on rHuPH20 enzymatic activity at 30° C. for 1 week Summary of Fit

| RSquare | 0.869567 |
|---|---|
| RSquare Adj | 0.768119 |
| Root Mean Square Error | 51.19549 |
| Mean of Response | 334.5882 |
| Observations (or Sum Wgts) | 17 |

Analysis of Variance

| Source | DF | Sum of Squares | Mean Square | F Ratio |
|---|---|---|---|---|
| Model | 7 | 157261.32 | 22465.9 | 8.5716 |
| Error | 9 | 23588.80 | 2621.0 | Prob > F |
| C. Total | 16 | 180850.12 | | 0.0023* |

TABLE 53-continued

Statistical analyses of the DOE study on HA, pH, and NaCl effect on rHuPH20 enzymatic activity at 30° C. for 1 week Effect Tests

| Source | Nparm | DF | Sum of Squares | F Ratio | Prob > F |
|---|---|---|---|---|---|
| pH | 1 | 1 | 7260.125 | 2.7700 | 0.1304 |
| HA | 1 | 1 | 79800.125 | 30.4467 | 0.0004* |
| NaCl | 1 | 1 | 18818.000 | 7.1798 | 0.0252* |
| pH*pH | 1 | 1 | 26012.463 | 9.9247 | 0.0117* |
| HA*HA | 1 | 1 | 1667.411 | 0.6362 | 0.4456 |
| HA*NaCl | 1 | 1 | 23562.250 | 8.9899 | 0.0150* |
| NaCl*NaCl | 1 | 1 | 1167.253 | 0.4454 | 0.5213 |

*Significant

It was noted that in almost all previous studies assessing insulin/rHuPH20 formulations in the absence HA, increasing pH had a significant and negative effect on rHuPH20 enzymatic activity, especially in the pH range of 6.0 to 8.0. In contrast, in this study in which HA was included in the formulations, the pH appeared to have little or no effect on rHuPH20 enzymatic activity. Thus, it appears that the presence of HA in the insulin/rHuPH20 formulation reduces or negates the negative effect that higher pH can have on the enzymatic activity of rHuPH20.

To further evaluate the usefulness of HA as a stabilizer, the insulin content was assessed by RP-HPLC on samples that had been stored at 2-8° C. for 9 months. The insulin content data and statistical analysis results are shown in Tables 54 and 55 below. The results clearly demonstrate the significance of pH and NaCl concentration on insulin solubility (p<0.0001 for both factors). As the pH increased, insulin solubility increased. As the NaCl concentration increased, insulin solubility decreased. The effect of HA on insulin solubility/content was not significant (p=0.2755). Thus, HA oligomers can be an excipient/stabilizer for rHuPH20/insulin or rHuPH20/insulin analog formulations.

Long term storage of formulations containing HA oligomers showed a significant increase in the level of rHuPH20 oxidation as compared to formulations that did not include added HA. The level of oxidation appeared to correlate well with the HA concentration, but was independent of pH or NaCl concentration (see Tables 55 and 56 below). HA contains glucuronic acid, which may be a potential oxygen donor so an anti-oxidant or oxygen scavenger might be called for if HA is an excipient in the final rHuPH20-insulin formulations. In this study some of the formulations were severely oxidized, yet the enzymatic activity remained reasonably intact (see Table 55), which confirmed that oxidized rHuPH20 still maintains a significant enzymatic activity. The multivariate statistical analyses indicated that the rHuPH20 enzymatic activities of these samples from long-term low temperature storage were significantly affected by HA (p=0.004, reduced enzymatic activity), but not pH or NaCl (p=0.1715 and 0.4766, respectively) (see Table 56 below).

TABLE 54

Effect of HA, pH, and NaCl on the insulin content for samples stored at 2-8° C. for 9 months Summary of Fit

| RSquare | 0.978698 |
|---|---|
| RSquare Adj | 0.951309 |
| Root Mean Square Error | 5.231467 |

TABLE 54-continued

Effect of HA, pH, and NaCl on the insulin content
for samples stored at 2-8° C. for 9 months

| Mean of Response | 74.63647 |
|---|---|
| Observations (or Sum Wgts) | 17 |

Analysis of Variance

| Source | DF | Sum of Squares | Mean Square | F Ratio |
|---|---|---|---|---|
| Model | 9 | 8801.6746 | 977.964 | 35.7335 |
| Error | 7 | 191.5778 | 27.368 | Prob > F |
| C. Total | 16 | 8993.2524 | | <.0001* |

Parameter Estimates

| Term | Estimate | Std Error | t Ratio | Prob > \|t\| |
|---|---|---|---|---|
| Intercept | −626.7315 | 67.81624 | −9.24 | <.0001* |
| pH | 106.24375 | 9.248015 | 11.49 | <.0001* |
| HA | −0.486111 | 0.411023 | −1.18 | 0.2755 |
| NaCl | −0.78475 | 0.073984 | −10.61 | <.0001* |
| (pH-7.3)*(pH-7.3) | −194.2562 | 63.73755 | −3.05 | 0.0186* |
| (pH-7.3)*(HA-5.5) | 3.7222222 | 2.906371 | 1.28 | 0.2411 |
| (HA-5.5)*(HA-5.5) | −0.549519 | 0.125901 | −4.36 | 0.0033* |
| (pH-7.3)*(NaCl-75) | 2.9325 | 0.523147 | 5.61 | 0.0008* |
| (HA-5.5)*(NaCl-75) | −0.0028 | 0.023251 | −0.12 | 0.9075 |
| (NaCl-75)*(NaCl-75) | −0.01288 | 0.004079 | −3.16 | 0.0160* |

*Significant

TABLE 55

Effect of HA, pH and NaCl on the oxidation
of rHuPH20 stored at 2-8° C. for 9 months Summary of Fit

| RSquare | 0.997321 |
|---|---|
| RSquare Adj | 0.993876 |
| Root Mean Square Error | 1.253363 |
| Mean of Response | 53.37529 |
| Observations (or Sum Wgts) | 17 |

Analysis of Variance

| Source | DF | Sum of Squares | Mean Square | F Ratio |
|---|---|---|---|---|
| Model | 9 | 4093.6132 | 454.846 | 289.5415 |
| Error | 7 | 10.9964 | 1.571 | Prob > F |
| C. Total | 16 | 4104.6096 | | <.0001* |

Parameter Estimates

| Term | Estimate | Std Error | t Ratio | Prob > \|t\| |
|---|---|---|---|---|
| Intercept | 58.118819 | 16.24751 | 3.58 | 0.0090* |
| pH | −3.83125 | 2.215653 | −1.73 | 0.1274 |
| HA | 4.9155556 | 0.098473 | 49.92 | <0.0001* |
| NaCl | 0.00245 | 0.017725 | 0.14 | 0.8940 |
| (pH-7.3)*(pH-7.3) | −72.34375 | 15.27033 | −4.74 | 0.0021* |
| (pH-7.3)*(HA-5.5) | −0.605556 | 0.696313 | −0.87 | 0.4133 |
| (HA-5.5)*(HA-5.5) | −0.26821 | 0.030164 | −8.89 | <0.0001* |
| (pH-7.3)*(NaCl-75) | 0.0545 | 0.125336 | 0.43 | 0.6768 |
| (HA-5.5)*(NaCl-75) | −0.009422 | 0.005571 | −1.69 | 0.1346 |
| (NaCl-75)*(NaCl-75) | −0.000262 | 0.000977 | −0.27 | 0.7964 |

*Significant

TABLE 56

Effect of HA, pH and NaCl on the enzymatic activity
of rHuPH20 stored at 2-8° C. for 9 months Summary of Fit

| RSquare | 0.8159 |
|---|---|
| RSquare Adj | 0.5792 |
| Root Mean Square Error | 18.33595 |
| Mean of Response | 519.2941 |
| Observations (or Sum Wgts) | 17 |

Analysis of Variance

| Source | DF | Sum of Squares | Mean Square | F Ratio |
|---|---|---|---|---|
| Model | 9 | 10430.079 | 1158.90 | 3.4470 |
| Error | 7 | 2353.450 | 336.21 | Prob > F |
| C. Total | 16 | 12783.529 | | 0.0584 |

Parameter Estimates

| Term | Estimate | Std Error | t Ratio | Prob > \|t\| |
|---|---|---|---|---|
| Intercept | 917.96806 | 237.6915 | 3.86 | 0.0062* |
| pH | −49.375 | 32.41369 | −1.52 | 0.1715 |
| HA | −6.055556 | 1.440608 | −4.20 | 0.0040* |
| NaCl | −0.195 | 0.25931 | −0.75 | 0.4766 |
| (pH-7.3)*(pH-7.3) | −51.25 | 223.3959 | −0.23 | 0.8251 |
| (pH-7.3)*(HA-5.5) | 0.8333333 | 10.18664 | 0.08 | 0.9371 |
| (HA-5.5)*(HA-5.5) | 1.3432099 | 0.441276 | 3.04 | 0.0187* |
| (pH-7.3)*(NaCl-75) | −0.4 | 1.833595 | −0.22 | 0.8335 |
| (HA-5.5)*(NaCl-75) | 0.0822222 | 0.081493 | 1.01 | 0.3466 |
| (NaCl-75)*(NaCl-75) | −0.00728 | 0.014297 | −0.51 | 0.6263 |

*Significant

Example 11

Effect of Salt Concentration, pH and Buffer
Concentration on rHuPH20 in the Presence of
Methylparaben In this example, a Box-Behnken experimental design was used to determine the optimal pH, salt concentration (NaCl) and buffer concentration (Hepes) for the stability of rHuPH20 at elevated temperatures in the presence of the phenolic preservative methylparaben. In this design of experiment (DOE) response surface method (RSM) experiment, three factors, namely varying concentrations of buffer and salt, and pH, were examined for their effects on rHuPH20 activity under accelerated conditions, whereby the samples were subjected to stresses, including elevated temperature and agitation. Measured responses included enzymatic activity and purity/content, as measured by reverse phased-HPLC.

The study was based on the DOE software package Design-Expert® 7.1. (StatEase, Minneapolis, Minn.). The ranges and midpoints of the Hepes concentration, NaCl concentration and pH used in the experiment are listed in Table 57 below. To carry out the study, a total of 13 different formulations, with 5 repeated central points, were made based on a random sequence that the software generated. Each sample contained 100 μg/mL rHuPH20 (from a 10 mg/mL solution in histidine/HCl, pH 6.5, 130 mM NaCl), 0.20% methylparaben (Fluka, Cat. No. 85265) and 0.025% propylparaben (American Custom Chemicals, San Diego, Cat. No. CHEM-19713), with varying concentrations of Hepes (Calbiochem, Cat No. 391338) and NaCl (EMD, SX0418-1) and pH as specified in Table 58 below. pH was adjusted using 1.0 N NaOH or HCl. The solutions were aliquoted into 2 mL type 1 glass vials (Wheaton, Cat. No. 223683) with rubber stoppers (Wheaton, Cat. No. 224100-072) and sealed with alumina caps, with 2 vials per formulation. The samples were placed in an incubator with the temperature set at 35° C. One set of vials was subjected to agitation using a Titer Plate shaker (LabLine) at 600 rpm for 3 days (35+ag). The other set of vials was kept at 35° C. for 5 days without agitation. Samples were submitted for testing following the incubation period.

TABLE 57

Ranges and Mid-points for Hepes, NaCl and pH

| Factor | Mid-point | Ranges |
| --- | --- | --- |
| Hepes concentration | 11 mM | 2-20 mM |
| NaCl concentration | 150 mM | 120-180 mM |
| pH | 7 | 6-8 |

TABLE 58

Box-Behnken design of RSM, including responses

| STD | Run # | Factor 1 NaCl mM | Factor 2 Hepes mM | Factor 3 pH | Response 1 Enz (35 + ag) | Response 2 SEC (35 + ag)* | Response 3 Enz (35) | Response 4 SEC (35)* |
| --- | --- | --- | --- | --- | --- | --- | --- | --- |
| 5 | 1 | 120 | 11 | 6 | 2119 | 38.91 | 7,474 | 95.54 |
| 15 | 2 | 150 | 11 | 7 | 6944 | 78.50 | 8,260 | 95.82 |
| 10 | 3 | 150 | 20 | 6 | 5744 | 70.96 | 8,784 | 94.94 |
| 1 | 4 | 120 | 2 | 7 | 5228 | 63.06 | 6,958 | 84.71 |
| 16 | 5 | 150 | 11 | 7 | 7023 | 80.69 | 8,022 | 93.95 |
| 7 | 6 | 120 | 11 | 8 | 2138 | 34.15 | 2,829 | 62.12 |
| 6 | 7 | 180 | 11 | 6 | 5864 | 70.36 | 8,704 | 93.53 |
| 8 | 8 | 180 | 11 | 8 | 5297 | 63.89 | 6,052 | 59.80 |
| 12 | 9 | 150 | 20 | 8 | 4554 | 55.72 | 5,378 | 74.59 |
| 13 | 10 | 150 | 11 | 7 | 5709 | 74.53 | 8,184 | 91.14 |
| 11 | 11 | 150 | 2 | 8 | 4031 | 42.09 | 4,392 | 61.61 |
| 4 | 12 | 180 | 20 | 7 | 6192 | 69.69 | 8,708 | 94.85 |
| 9 | 13 | 150 | 2 | 6 | 8178 | 81.28 | 9,642 | 91.32 |
| 17 | 14 | 150 | 11 | 7 | 7464 | 80.22 | 8,651 | 93.58 |
| 3 | 15 | 120 | 20 | 7 | 7101 | 71.51 | 8,681 | 89.31 |
| 2 | 16 | 180 | 2 | 7 | 7194 | 77.18 | 8,755 | 93.34 |
| 14 | 17 | 150 | 11 | 7 | 6482 | 74.79 | 8,721 | 93.51 |

*Size exclusion chromatography (SEC) main peak percentage as compared to a reference.

Enzymatic activity was measured as described in Example 2b above. Size exclusion chromatography (SEC) was used to evaluate purity by measuring the percentage of the main peak as compared to a reference sample (see Example 4 above). SEC was performed using the following conditions: 1× Phosphate Buffered Saline (PBS), a Toso BioScience G2000 SWXL column, and a flow rate set at 1 mL/min. Data were collected as described above and means were reported and entered into the design table following the sample sequence provided by the DOE software. The data are shown in Table 58 above.

For data analysis, the raw data were analyzed as follows. Briefly, the data were fit into a quadratic model as the starting point. The ANOVA were performed based on the quadratic model but the parameters typically needed to be reduced in order to make the model meet more closely to all of the following criteria: model significant level P<0.05, p value for lack of fit (P>0.1), adequate precision level >4, and predicted R-square within 0.2 of the adjusted R-square. Finally, residual analysis and diagnostics plots were checked to make sure the ANOVA assumptions were met. In some cases, the data needed to be transformed in order to meet those criteria; in those cases, the raw data was transformed by a suitable mathematic equation then followed the statistical analysis as described previously. The ANOVA test models for the model used for each response are set forth in Table 59 below, which indicates the response, the model equation, whether a transformation was used and the type of transformation, the model P value and the lack of fit P value.

TABLE 59

ANOVA Test for each model

| | Model* | Transform | Model P-Value | Lack of fit P-Value |
| --- | --- | --- | --- | --- |
| Response 1, enzymatic activity (35° C. - AG) | Y = A + C + A2 + C2 | None | Significant P = 0.009 | Not significant P = 0.091 |
| Response 2, SEC main peak (35° C. - AG) | Y = A + C + A2 + C2 | Logit | Significant P = 0.0007 | Not significant P = 0.109 |

TABLE 59-continued

ANOVA Test for each model

| | Model* | Transform | Model P-Value | Lack of fit P-Value |
| --- | --- | --- | --- | --- |
| Response 3, enzymatic activity (35° C. - 5D) | Y = A + B + C + AB + BC + AC + A2 + B2 + C2 | None | Significant P = 0.0002 | Not significant P = 0.076 |
| Response 4, SEC main peak (35° C. - 5D) | Y = A + B + C + A2 + C2 | Logit | Significant P < 0.0001 | Not significant P = 0.147 |

*A—NaCl; B—Hepes buffer; C—pH

A. Effects of pH, NaCl and Buffer Concentrations on rHuPH20 at Accelerated Temperature with Agitation The ANOVA models show, that under excessive agitation at 35° C., buffer concentration has No effect of enzymatic activity and content/purity of rHuPH20 (see Table 59 above, Response 1 and 2, wherein the model equation does not include buffer). rHuPH20 was predicted to be most stable between pH 6.5-7.3 with a NaCl concentration between 145-180 mM. Outside these ranges, the model predicted rHuPH20 activity would decline, in particular, when the pH is 8.0 and when the salt concentration is at the lowest concentration (120 mM). Under these accelerated conditions, the highest rHuPH20 activity measured was about 8100 U/mL (STD 9 in Table 56 above), which is about 65% of the expected rHuPH20 activity (about 12,000 U/mL) based on 100 μg/mL enzyme. Similar results were observed for the purity/content of the rHuPH20 as determined by SEC, with the loss of main peak content for the most stable formulation about 20% that of the expected.

The optimal ranges for salt concentration and pH for rHuPH20 enzymatic activity were slightly narrower than those for rHuPH20 content/purity. Thus, enzymatic activity of rHuPH20 is more sensitive to stressed conditions, therefore indicating enzymatic activity of rHuPH20 is a better method to indicate stability.

B. Effects of pH, NaCl and Buffer Concentrations on rHuPH20 at Accelerated Temperature without Agitation The data shows that under less stressful conditions (i.e., no agitation), smaller decreases in enzymatic activity and less main peak loss were observed. For example, for the better samples, only a 20% loss in activity was observed (compared to 35% for samples incubated with agitation) and less than 5% loss in main peak was observed (compared to 20% for samples incubated with agitation). Additionally, the ANOVA models show that the salt concentration does not have a significant effect on enzyme activity. rHuPH20 remains enzymatically active at a pH less than 6.5, as long as the salt concentration is at least 130 mM. Additionally, optimal enzymatic activity is observed with a pH less than 7.

Example 12

Stability Study of Insulin Lispro/rHuPH20 or Insulin Aspart/RHuPH20 with Preservatives Six Month Interim Data Tables In this example, the stability of various insulin Lispro/rHuPH20 formulations was evaluated under three storage conditions: 5° C., 25° C. and 30° C. over time. One formulation was also evaluated under two physical accelerated stress conditions: multiple freeze/thaw cycles and agitation at 25° C. The formulations varied in pH and preservative levels. Stability was evaluated by measuring general appearance and characteristics, rHuPH20 enzymatic activity and rHuPH20 and insulin analog purity.

The insulin Lispro/rHuPH20 formulations are set forth in Table 60 below.

TABLE 60

| Insulin Lispro/rHuPH20 Formulations or Insulin Aspart/rHuPH20 Formulations | | | | | | | | |
|---|---|---|---|---|---|---|---|---|
| # | pH | Buffer | Tonicity Modifier | Surfactant | Preservatives | | API | |
| 1 | 7.2 | 30 mM Tris/HCl | 50 mM NaCl | 100 mM Methionine | 0.01% Poloxamer 188 | 0.125% phenol | 0.075% m-cresol | 600 U/mL rHuPH20 | 3.5 mg/mL Lispro or Aspart |
| 2 | 7.4 | 30 mM Tris/HCl | 50 mM NaCl | 100 mM Methionine | 0.01% Poloxamer 188 | 0.125% phenol | 0.075% m-cresol | 600 U/mL rHuPH20 | 3.5 mg/mL Lispro or Aspart |
| 3 | 7.6 | 30 mM Tris/HCl | 50 mM NaCl | 100 mM Methionine | 0.01% Poloxamer 188 | 0.125% phenol | 0.075% m-cresol | 600 U/mL rHuPH20 | 3.5 mg/mL Lispro orAspart |
| 4 | 7.2 | 30 mM Tris/HCl | 50 mM NaCl | 100 mM Methionine | 0.01% Poloxamer 188 | 0.10% phenol | 0.075% m-cresol | 600 U mL rHuPH20 | 3.5 mg/mL Lispro or Aspart |
| 5 | 7.4 | 30 mM Tris/HCl | 50 mM NaCl | 100 mM Methionine | 0.01% Poloxamer 188 | 0.10% phenol | 0.075% m-cresol | 600 Uml rHuPH20 | 3.5 mg/mL Lispro or Aspart |
| 6 | 7.6 | 30 mM Tris/HCl | 50 mM NaCl | 100 mM Methionine | 0.01% Poloxamer 188 | 0.10% phenol | 0.075% m-cresol | 600 U/mL rHuPH20 | 3.5 mg/mL Lispro or Aspart |
| 7 | 7.2 | 30 mM Tris/HCl | 50 mM NaCl | 100 mM Methionine | 0.01% Poloxamer 188 | 0.14% phenol | 0.085% m-cresol | 600 U/mL rHuPH20 | 3.5 mg/mL Lispro or Aspart |
| 8 | 7.6 | 30 mM Tris/HCl | 50 mM NaCl | 100 mM Methionine | 0.01% Poloxamer 188 | 0.14% phenol | 0.085% m-cresol | 600 U/mL rHuPH20 | 3.5 mg/mL Lispro or Aspart |

One (1) mL of each formulation was stored in USP Type 1 borosilicate 2 mL glass vial with a chlorobutyl rubber stopper and an aluminum seal. Each formulation was incubated, individually, at 5±3° C., 25±2° C. and 30±3° C. and stability measurements were recorded at 0, 0.5, 1, 2, 3 and 6 months. Formulation #2 was subjected to agitation (shaking at 650 rpm) at 25° C. for 24 hours. Formulation #2 was subjected to 5 cycles of freeze/thaw by alternating the storage condition between a −30° C. freezer and room temperature at the bench. The sample was left at each condition for at least 2 hours for each cycle (i.e., 2 hours in −30° C. freezer, remove and place on bench top at room temperature for 2 hours was considered 1 cycle).

Stability was assessed by measuring pH, appearance, including osmolality, turbidity at 350 nm and qualitative observation, rHuPH20 enzymatic activity, the percent purity and percent recovery of rHuPH20 by RP-HPLC, the percent purity and percent recovery of insulin Lispro by RP-HPLC, and the percent purity of insulin Lispro by non-denaturing and denaturing SEC (see Examples 2-5). For osmolality, the stability acceptance criteria was 275±30 mOsm/kg. For appearance, the stability acceptance criteria was that it was a clear, colorless solution. For rHuPH20 activity, the stability acceptance criteria was that the formulation exhibited >375 U/mL (based on >75 U/µg). For rHuPH20 percent recovery by RP-HPLC, the target acceptable specification was 3-7 µg/mL (60-140%) by RP-HPLC. For insulin purity by RP-HPLC, the target acceptable specification was ≥90% purity by RP-HPLC. For insulin recovery by RP-HPLC, the target acceptable specification was 90-100 U/mL (90-110%) by RP-HPLC. For percent purity by non-denaturing SEC, the target acceptable specification was 2% High Molecular Weight (HMWt) Insulin species by peak area. For insulin purity by denaturing SEC, the target acceptable specification was ≥2% High Molecular Weight (HMWt) Insulin species by peak area with denaturing SEC.

The results are summarized below. It was determined that in the insulin Lispro/rHuPH20 formulations set forth in Table 60, formulations #1, #2 and #3 were formulated with low content of insulin lispro at T=0 (91.22%, 91.40% or 91.30%, respectively), whereas the other formulations contained approximately 100% protein content.

1. 3-Month Time Point
a. Insulin Lispro

All of the tested formulations were stable at 5±3° C. up to the 3 month time point for both rHuPH20 and insulin Lispro. All formulations were clear and colorless with no particles at all time points and temperatures. Insulin Lispro content was low (approximately 91% recovery of target) for formulations #1-#3, but this appears to be a formulation preparation error as the percent recovery was constant, as expected at 5° C.

At the 25±2° C., rHuPH20 in all of the formulations was stable, with the exception of formulation #8 which fell below the 375 U/mL target specification for rHuPH20 enzymatic activity between 2 and 3 months. This was not unexpected as formulation #8 had a high pH and high preservative concentration and in general, rHuPH20 is more stable at lower pH and lower preservative concentration. Insulin Lispro was generally stable in all formulations at 25° C. out to the 3 month time point, but purity began to slightly decline as assessed by RP-HPLC after approximately 1 month.

At 30±3° C. only the lowest pH formulations (#1 and #4, both pH 7.2) were above the target specification for rHuPH20 enzymatic activity (>375 U/mL) after 1 month at 30° C. Formulation #2 was above the target specification after 2 weeks at 30° C. but was below 375 U/mL by 1 month. Insulin Lispro was generally stable within the target specification for 3 months in all formulations at 30° C., but there was a slightly greater decrease in purity than was observed at 25° C. The decrease in purity was accompanied by a decrease in content at 30° C. that was not apparent at 25° C. After the 3-month time point, the 30° C. condition was terminated.

b. Insulin Aspart

All formulations were clear and colorless with no particles at all time points and temperatures. All of the tested formulations were stable at 5±3° C. up to the 3 month time point for both rHuPH20 and insulin Aspart.

rHuPH20 met the target specifications for all of the formulations held at 25±2° C. out to 3 months with the exception of formulation #7 which fell below the 375 U/mL target specification for rHuPH20 activity between 2 and 3 months. This is slightly unexpected as formulations #7 and #8 are identical except for pH values (7.2 and 7.6, respectively), and in general, rHuPH20 has been more stable at a lower pH. This unexpected result is likely due to the fact that formulation #7 started at a lower activity (500 U/mL) and content (93.8%) than targeted (600 U/mL and 100%, respectively), and is further supported by the acceptable purity values for formulations #7 and #8. Insulin Aspart was stable in all formulations at 25° C. out to the 3 month time point but there is a slight downward trend in purity and % recovery. rHuPH20 was less stable in all of the formulations held at 30±3° C. as compared to those at 25° C. The lowest pH formulations (#1 and #4, both pH 7.2) and the lowest total preservative formulations (#4 and #5, total preservative level=0.175%) were still above target specification for rHuPH20 enzymatic activity after 1 month at 30° C. Formulation #2 was just below target specification after 1 month at 30° C. and formulation #6 was slightly over target specification for activity after 1 month but slightly under after 2 weeks. Formulations #1-#6 remained generally within target specification for rHuPH20 enzymatic activity after 2 weeks at 30° C. Insulin Aspart was stable within target specification for 3 months in all formulations at 30° C. but there was a slightly greater downward trend in purity and % recovery than observed at 25° C. The 30±3° C. portion of the study was terminated after the 3-month time point.

2. 6-Month Time Point
a. Insulin Lispro

All formulations were clear and colorless with no particles at all time points and temperatures. All of the tested formulations were stable at 5° C. at the 6-month time point for both rHuPH20 and insulin Lispro. The low insulin Lispro content (approximately 91% recovery of target), for formulations #1-#3 as previously observed but the percent recovery was still flat at 5° C.

At 25° C., rHuPH20 continued to also was stable (>375 U/mL rHuPH20 activity) for formulation #1, #2, #4, and #5. These formulations were all at lower pH (7.2 or 7.4) with either the current USP preservative level (#1, #2: 0.125% phenol, 0.075% m-cresol) or a slightly lower preservative level (#4, #5: 0.1% phenol, 0.075% m-cresol). All 8 of the formulations remained within the target rHuPH20 percent recovery specification at 6 months but there was a clear decrease with respect to both rHuPH20 purity and recovery by RP-HPLC. The declining purity by RP-HPLC, content by RP-HPLC, and purity by non-denaturing SEC observed for insulin Lispro noted after 3 months at 25° C. were more apparent by 6 months. The purity by denaturing SEC may be decreasing very slightly but all of the main peak values are still >99.4% so any loss is very small up to this point.

b. Insulin Aspart

All formulations were clear and colorless with no particles at all time points and temperatures. All of the tested formulations were stable at 5±3° C. at the 6-month time point for both rHuPH20 and insulin Aspart.

rHuPH20 continued to meet target activity specifications for enzymatic activity (>375 U/mL) for 4 of the formulations held at 25±2° C. (#1, #2, #4, and #5) out to 6 months. These formulations were all at lower pH (7.2 or 7.4) with either the current USP preservative level (#1, #2: 0.125% phenol, 0.075% m-cresol) or a slightly lower preservative level (#4, #5: 0.1% phenol, 0.075% m-cresol). All 8 of the formulations remained within target rHuPH20 percent recovery specification at 6 months but there was a clear decrease observed with respect to both rHuPH20 purity and recovery by RP-HPLC. The downward trends for insulin Aspart noted after 3 months at 25° C. were more apparent by 6 months for purity by RP-HPLC, content by RP-HPLC, and purity by non-denaturing SEC. The purity by denaturing SEC may be trending very slightly downward but all of the main peak values are still >99.5% so any loss is very small up to this point.

3. Accelerated Conditions—Agitation at 25° C. and Freeze/Thaw a. Insulin Lispro

Formulation #2 was cloudy after agitation at 25° C. for 24 hours. Insulin Lispro was stable for both conditions, although percent recovery decreased to about 75% after 5 freeze thaw cycles. rHuPH20 met target activity specifications (>375 U/mL) for the sample subjected to agitation at 25° C. for 24 hours. After 5 freeze/thaw cycles, rHuPH20 was enzymatically inactive.

b. Insulin Aspart

Similar results were obtained for the Insulin Aspart Formulation #2 as was obtained for the Insulin Lispro formulation under agitations or freeze/thaw conditions.

Example 13

Stability Study of Insulin Lispro/rHuPH20, Insulin Aspart/rHuPH20 or Insulin Glulisine/rHuPH20 with Varied Preservatives Two or Three Month Interim Data Tables In this example, the stability of various insulin Lispro-rHuPH20, insulin Aspart-rHuPH20 or Insulin Glulisine-rHuPH20 formulations were evaluated under four different storage conditions: 5° C., 15° C., 25° C. and 30° C. over time. The formulations varied in pH, salt concentration and glycerin concentration. Stability was evaluated by measuring general appearance and characteristics, rHuPH20 enzymatic activity and rHuPH20 and insulin analog purity. This study was intended to provide supporting data for phase 3 clinical development at 3 preservative levels: the preservative levels contained in commercial insulin preparations (Novolog) or EP-B (European Pharmacopoeia) and USP (United States Pharmacopeia) preservative levels.

The insulin Lispro/rHuPH20 formulations are set forth in Table 61 below. The insulin Aspart/rHuPH20 formulations are set forth in Table 62. The insulin Glulisine/rHuPH20 formulations are set forth in Table 63. The base formulation contained 3.5 mg/mL insulin Lispro or Aspart, 600 U/mL rHuPH20, 30 mM Tris/HCl, 20 mM methionine and 0.01% Poloxamer 188. The pH, NaCl concentrations and glycerin concentrations were varied within the three base preservative concentrations.

For the insulin Lispro/rHuPH20 and insulin Aspart/rHuPH20 formulations set forth in Table 61 and 62, formulations A1-A4 have the commercial Novolog® preservative level: 0.15% phenol and 0.172% m-cresol; formulations B1-B5 have an EP-B preservative level: 0.1% phenol and 0.15% m-cresol and formulation U1 has an USP preservative level: 0.125% phenol and 0.075% m-cresol.

In addition, for the insulin Glulisine/rHuPH20 formulations set forth in Table 63, formulation 1 has the commercial Novolog® preservative level: 0.15% phenol and 0.172% m-cresol. Formulation 2 has an EP-B preservative level: 0.1% phenol and 0.15% m-cresol. Formulation 3 has an USP preservative level: 0.125% phenol and 0.075% m-cresol. Formulations 4-7 have the Novolog® commercial preservative level and vary one or more factors for comparison with formulation 1. The variations between formulations are indicated in boldface type. Formulation 4 has a higher concentration of NaCl and formulation 7 has a different surfactant. Formulations 5 and 6 vary from formulation 4 in the concentration of methionine and the pH.

TABLE 61

| | | | Insulin Lispro/rHuPH20 Formulations | | | | | | |
|---|---|---|---|---|---|---|---|---|---|
| # | pH | Buffer | Tonicity Modifier | | Surfactant | Preservatives | | API | |
| A1 | 7.6 | 30 mM Tris/HCl | 100 mM NaCl | 20 mM Methionine | 50 mM Glycerin | 0.01% Poloxamer 188 | 0.15% phenol | 0.172% m-cresol | 600 U/mL rHuPH20 | 3.5 mg/mL Lispro |
| A2 | 7.6 | 30 mM Tris/HCl | 80 mM NaCl | 20 mM Methionine | 50 mM Glycerin | 0.01% Poloxamer 188 | 0.15% phenol | 0.172% m-cresol | 600 U/mL rHuPH20 | 3.5 mg/mL Lispro |
| A3 | 7.4 | 30 mM Tris/HCl | 80 mM NaCl | 20 mM Methionine | 50 mM Glycerin | 0.01% Poloxamer 188 | 0.15% phenol | 0.172% m-cresol | 600 U/mL rHuPH20 | 3.5 mg/mL Lispro |
| A4 | 7.6 | 30 mM Tris/HCl | 50 mM NaCl | 20 mM Methionine | 70 mM Glycerin | 0.01% Poloxamer 188 | 0.15% phenol | 0.172% m-cresol | 600 U/mL rHuPH20 | 3.5 mg/mL Lispro |
| B1 | 7.6 | 30 mM Tris/HCl | 100 mM NaCl | 20 mM Methionine | 50 mM Glycerin | 0.01% Poloxamer 188 | 0.15% phenol | 0.1% m-cresol | 600 U/mL rHuPH20 | 3.5 mg/mL Lispro |
| B2 | 7.6 | 30 mM Tris/HCl | 80 mM NaCl | 20 mM Methionine | 50 mM Glycerin | 0.01% Poloxamer 188 | 0.1% phenol | 0.15% m-cresol | 600 U/mL rHuPH20 | 3.5 mg/mL Lispro |

TABLE 61-continued

Insulin Lispro/rHuPH20 Formulations

| # | pH | Buffer | Tonicity Modifier | | Surfactant | Preservatives | | API | |
|---|---|---|---|---|---|---|---|---|---|
| B3 | 7.4 | 30 mM Tris/HCl | 80 mM NaCl | 20 mM Methionine | 50 mM Glycerin | 0.01% Poloxamer 188 | 0.1% phenol | 0.15% m-cresol | 600 U/mL rHuPH20 | 3.5 mg/mL Lispro |
| B4 | 7.6 | 30 mM Tris/HCl | 50 mM NaCl | 20 mM Methionine | 70 mM Glycerin | 0.01% Poloxamer 188 | 0.1% phenol | 0.15% m-cresol | 600 U/mL rHuPH20 | 3.5 mg/mL Lispro |
| B5 | 7.2 | 30 mM Tris/HCl | 50 mM NaCl | 20 mM Methionine | 70 mM Glycerin | 0.01% Poloxamer 188 | 0.1% phenol | 0.15% m-cresol | 600 U/mL rHuPH20 | 3.5 mg/mL Lispro |
| U1 | 7.4 | 30 mM Tris/HCl | 80 mM NaCl | 20 mM Methionine | 50 mM Glycerin | 0.01% Poloxamer 188 | 0.125% phenol | 0.075% m-cresol | 600 U/mL rHuPH20 | 3.5 mg/mL Lispro |

TABLE 62

Insulin Aspart/rHuPH20 Formulations

| # | pH | Buffer | Tonicity Modifier | | Surfactant | Preservatives | | API | |
|---|---|---|---|---|---|---|---|---|---|
| A1 | 7.4 | 30 mM Tris/HCl | 100 mM NaCl | 20 mM Methionine | 50 mM Glycerin | 0.01% Poloxamer 188 | 0.15% phenol | 0.172% m-cresol | 600 U/mL rHuPH20 | 3.5 mg/mL Aspart |
| A2 | 7.4 | 30 mM Tris/HCl | 80 mM NaCl | 20 mM Methionine | 50 mM Glycerin | 0.01% Poloxamer 188 | 0.15% phenol | 0.172% m-cresol | 600 U/mL rHuPH20 | 3.5 mg/mL Aspart |
| A3 | 7.2 | 30 mM Tris/HCl | 80 mM NaCl | 20 mM Methionine | 50 mM Glycerin | 0.01% Poloxamer 188 | 0.15% phenol | 0.172% m-cresol | 600 U/mL rHuPH20 | 3.5 mg/mL Aspart |
| A4 | 7.6 | 30 mM Tris/HCl | 50 mM NaCl | 20 mM Methionine | 70 mM Glycerin | 0.01% Poloxamer 188 | 0.15% phenol | 0.172% m-cresol | 600 U/mL rHuPH20 | 3.5 mg/mL Aspart |
| B1 | 7.4 | 30 mM Tris/HCl | 100 mM NaCl | 20 mM Methionine | 50 mM Glycerin | 0.01% Poloxamer 188 | 0.1% phenol | 0.15% m-cresol | 600 U/mL rHuPH20 | 3.5 mg/mL Aspart |
| B2 | 7.4 | 30 mM Tris/HCl | 80 mM NaCl | 20 mM Methionine | 50 mM Glycerin | 0.01% Poloxamer 188 | 0.1% phenol | 0.15% m-cresol | 600 U/mL rHuPH20 | 3.5 mg/mL Aspart |
| B3 | 7.2 | 30 mM Tris/HCl | 80 mM NaCl | 20 mM Methionine | 50 mM Glycerin | 0.01% Poloxamer 188 | 0.1% phenol | 0.15% m-cresol | 600 U/mL rHuPH20 | 3.5 mg/mL Aspart |
| B4 | 7.6 | 30 mM Tris/HCl | 50 mM NaCl | 20 mM Methionine | 70 mM Glycerin | 0.01% Poloxamer 188 | 0.1% phenol | 0.15% m-cresol | 600 U/mL rHuPH20 | 3.5 mg/mL Aspart |
| B5 | 7.2 | 30 mM Tris/HCl | 50 mM NaCl | 20 mM Methionine | 70 mM Glycerin | 0.01% Poloxamer 188 | 0.1% phenol | 0.15% m-cresol | 600 U/mL rHuPH20 | 3.5 mg/mL Aspart |
| U1 | 7.2 | 30 mM Tris/HCl | 80 mM NaCl | 20 mM Methionine | 50 mM Glycerin | 0.01% Poloxamer 188 | 0.125% phenol | 0.075% m-cresol | 600 U/mL rHuPH20 | 3.5 mg/mL Aspart |

TABLE 63

Insulin Glulisine/rHuPH20 Formulations

| # | pH | Buffer | Tonicity Modifier | | Surfactant | Preservatives | | API | |
|---|---|---|---|---|---|---|---|---|---|
| 1 | 7.3 | 20 mM Tris/HCl | 100 mM NaCl | 20 mM Methionine | 0.001% Polysorbate 20 | 0.15% phenol | 0.172% m-cresol | 600 U/mL rHuPH20 | 3.5 mg/mL Glulisine |
| 2 | 7.3 | 20 mM Tris/HCl | 100 mM NaCl | 20 mM Methionine | 0.001% Polysorbate 20 | 0.10% phenol | 0.150% m-cresol | 600 U/mL rHuPH20 | 3.5 mg/mL Glulisine |
| 3 | 7.3 | 20 mM Tris/HCl | 100 mM NaCl | 20 mM Methionine | 0.001% Polysorbate 20 | 0.125% phenol | 0.075% m-cresol | 600 U/mL rHuPH20 | 3.5 mg/mL Glulisine |

TABLE 63-continued

Insulin Glulisine/rHuPH20 Formulations

| # | pH | Buffer | Tonicity Modifier | Surfactant | Preservatives | | API | |
|---|---|---|---|---|---|---|---|---|
| 4 | 7.3 | 20 mM Tris/HCl | 140 mM NaCl | 20 mM Methionine | 0.001% Polysorbate 20 | 0.15% phenol | 0.172% m-cresol | 600 U/mL rHuPH20 | 3.5 mg/mL Glulisine |
| 5 | 7.3 | 20 mM Tris/HCl | 140 mM NaCl | 0 mM Methionine | 0.001% Polysorbate 20 | 0.15% phenol | 0.172% m-cresol | 600 U/mL rHuPH20 | 3.5 mg/mL Glulisine |
| 6 | 7.0 | 20 mM Tris/HCl | 140 mM NaCl | 20 mM Methionine | 0.001% Polysorbate 20 | 0.15% phenol | 0.172% m-cresol | 600 U/mL rHuPH20 | 3.5 mg/mL Glulisine |
| 7 | 7.3 | 20 mM Tris/HCl | 100 mM NaCl | 20 mM Methionine | 0.01% Poloxamer 188 | 0.15% phenol | 0.172% m-cresol | 600 U/mL rHuPH20 | 3.5 mg/mL Glulisine |

One (1) mL of each formulation was stored and incubated at various temperatures as described in Example 12 above in USP Type 1 borosilicate 2 mL glass vial with a chlorobutyl rubber stopper and an aluminum seal. Stability measurements were recorded at various times: t=0, 0.25, 0.5, 1, 2, 3, 6 or 9 months. Stability also was assessed by measuring pH, appearance, rHuPH20 enzymatic activity, percent purity and percent recovery of rHuPH20 by RP-HPLC, percent purity and percent recovery of insulin Lispro by RP-HPLC, and the percent purity of insulin Lispro by non-denaturing and denaturing SEC (see Examples 2-5 and Example 12). The stability acceptance criteria or target specification for each parameter tested are the same as described in Example 12. Samples were only evaluated at a subsequent timepoint if the results indicated ≥30% of the initial level.

The results are summarized below.

1. 1-Month Time Point a. Insulin Lispro

All formulations were clear and colorless with no particles at all time points and temperatures. All of the tested formulations were stable at 5±3° C. up to the 1 month time point for both rHuPH20 and insulin lispro. The formulations at 15±2° C. were not evaluated at the one month time point.

The rHuPH20 was stable in most of the formulations held at 25±2° C. out to 1 month with the exception of formulations A1, A2, A4 and B4. Formulations A1, A2, and B4 fell below the 375 U/mL target specification for rHuPH20 enzymatic activity between 2 weeks and 1 month and formulation A4 fell below target specification between 1 and 2 weeks after storage at 25° C. These formulations had commercial Novolog or EP-B levels of preservative with a high pH (pH 7.6), which disfavors rHuPH20 stability. The single EP-B formulation (B4) that had <375 U/mL hyaluronidase activity after 1 month at 25° C. had a pH 7.6 and low sodium chloride concentration (50 mM) which combined were disfavorable for rHuPH20. The other EP-B formulations at pH 7.6 with higher sodium chloride concentrations (80 mM or 100 mM) both remained well above the target level of 375 U/mL rHuPH20 enzymatic activity after 1 month at 25° C. All other formulations were well above the target specification after 1 month of storage at 25° C. Insulin lispro was stable in all formulations at 25° C. out to the 1 month time point but the percent purity by RP-HPLC began to decrease slightly.

The rHuPH20 was less stable in all of the formulations held at 30±2° C. as compared to those at 25±2° C. The USP formulation maintained acceptable rHuPH20 activity out to 1 month at 30° C. but none of the commercial preservative (A1-A4) or EP-B (B1-B5) formulations remained above the target specification after 1 week storage at 30° C. Insulin lispro was stable within target specification for 1 month in all formulations at 30° C. but the percent purity by RP-HPLC is decreasing slightly.

b. Insulin Aspart

All formulations were clear and colorless with no particles at all time points and temperatures. All formulations were stable at 5±3° C. up to the 1 month time point for both rHuPH20 and insulin Aspart. The formulations at 15±2° C. were not evaluated at the one month time point.

rHuPH20 was stable in all of the formulations held at 25±2° C. out to 1 month with the exception of formulations A4 and B4 which fell below the 375 U/mL target specification between 1-2 weeks and 2 weeks-1 month, respectively. These formulations had commercial Novolog® or EP-B levels of preservative with low salt (50 mM) and high pH (7.6), which are each conditions that disfavor rHuPH20 stability. All other formulations were above the target specification for rHuPH20 enzymatic activity after 1 month of storage at 25° C. Insulin Aspart was stable in all formulations at 25° C. out to the 1 month time point. Insulin Aspart total content was lower than expected but values are consistent from time=0.

rHuPH20 was less stable in all of the formulations held at 30±2° C. as compared to those at 25±2° C. The USP formulation (U1) maintained acceptable rHuPH20 activity out to 1 month at 30° C. Several of the EP-B formulations maintained acceptable rHuPH20 activity out to 1 week but none of the Novolog® preservative formulations maintained acceptable activity after 1 week of storage at 30° C. Insulin Aspart was stable within target specification for 1 month for all formulations at 30° C. but there is a slight downward trend noticeable for percent purity by RP-HPLC.

c. Insulin Glulisine

All formulations were clear and colorless with no particles at all time points and temperatures. All formulations were stable at 5±3° C. up to the 1 month time point for both rHuPH20 and insulin Glulisine. The formulations at 15±2° C. were not evaluated at the one month time point.

rHuPH20 was stable in all of the formulations held at 25±2° C. out to 1 month. There was some slight downward trending for some of the formulations with respect to rHuPH20 activity and rHuPH20 purity by RP-HPLC. Insulin Glulisine was stable in all formulations at 25° C. out to the 1 month time point but also showed a slight downward trend with respect to purity and percent recovery.

The rHuPH20 was less stable in all of the formulations held at 30±2° C. as compared to those at 25±2° C. Four (4) of the 7 test articles failed to meet the target rHuPH20 activity specification of >375 U/mL after 1 week at 30° C. Formulation 6 showed acceptable activity for only 1 week, formulation 2 demonstrated acceptable activity for 2 weeks, and the USP formulation (#3) maintained acceptable rHuPH20 activity (532 U/mL) out to 1 month at 30° C. Insulin Glulisine was stable within target specification for 1 month in all formulations at 30° C., but there was a clear downward trend noticeable for percent purity and percent recovery by RP-HPLC.

2. 2-Month Time Point a. Insulin Lispro

All formulations were clear and colorless with no particles at all time points and temperatures. All of the tested formulations were stable at 5±3° C. up to the 2 month time point for both rHuPH20 and insulin lispro.

All test articles were also stable at 15±2° C. up to the 2 month time point for both rHuPH20 and insulin lispro. There may be some very slight trending downward for rHuPH20 enzymatic activity but no other obvious downward trending in stability.

The rHuPH20 was not stable in the commercial preservative formulations (A1-A4) at 25±2° C. out to 2 months, but formulation A3 had good activity at 1 month (436 U/mL) and was only slightly below the intended >375 U/mL specification at 2 months (361 U/mL). Four (4) of the 5 EP-B formulations (B1, B2, B3, and B5) were above the 375 U/mL target specification after 2 months at 25° C. and had good rHuPH20 purity and recovery. The USP formulation (U1) also was above the rHuPH20 activity target specification after 2 months at 25° C. with a value of 510 U/mL and correspondingly high purity and recovery values. Insulin lispro was stable in all formulations at 25° C. out to the 2 month time point but the downward trends identified at 1 month continued.

As identified at 1 month, the rHuPH20 was less stable in all of the formulations held at 30±2° C. as compared to those at 25±2° C. and all A (commercial preservative) and B (EP-B preservative) formulations were well below the target rHuPH20 activity specification by 2 months at 30° C. The USP formulation just maintained acceptable rHuPH20 activity (375 U/mL) out to 2 months at 30° C., but dipped below specification at the 1 month timepoint (334 U/mL). This may be due to inherent variability in the rHuPH20 activity assay or sample variation, but still demonstrates the general downward trend in stability at 30° C. Insulin lispro was stable within target specification for 2 months in all formulations at 30° C., but there is a definite downward trend noticeable for percent purity and recovery by RP-HPLC as well as percent purity by non-denaturing SEC.

b. Insulin Aspart

All formulations were clear and colorless with no particles at all time points and temperatures. All formulations were stable at 5±3° C. up to the 2 month time point for both rHuPH20 and insulin Aspart. All test articles were also stable at 15±2° C. up to the 2 month time point for both rHuPH20 and insulin Aspart. A slight decrease was observed for rHuPH20 enzymatic activity, purity, and recovery.

The rHuPH20 was not stable in 3 of the 4 commercial preservative formulations (A2, A3 and A4) at 25±2° C. out to 2 months, but formulation A 1 had acceptable activity at 2 months (385 U/mL) and test article A3 was only slightly below the intended >375 U/mL specification at 2 months (357 U/mL). Three (3) of the 5 EP-B formulations (B1, B2 and B3) were still well above the 375 U/mL target specification for rHuPH20 enzymatic activity after 2 months at 25° C. and had acceptable but uncharacteristically lower than expected rHuPH20 purity and recovery based on experience with similar formulations. The USP formulation (U1) was still well above the rHuPH20 activity target specification after 2 months at 25° C. with a value of 444 U/mL with acceptable purity and recoveries. Insulin Aspart was stable in all formulations at 25° C. out to the 2 month time point but there were slight downward trends in purity by RP-HPLC and non-denaturing SEC.

As identified at 1 month, rHuPH20 was less stable in all of the formulations held at 30±2° C. as compared to those at 25±2° C., and all A and B formulations were well below the target rHuPH20 enzymatic activity specification by 2 months at 30° C. The USP formulation (U1) had acceptable rHuPH20 activity (382 U/mL) out to 2 months at 30° C. rHuPH20 percent purity and recovery for the USP formulation were slightly lower than expected based on experience with similar formulations as described above but were within acceptable limits. Insulin Aspart was stable within target specification for 2 months in all formulations at 30° C. but there was a downward trend noticeable for percent purity by RP-HPLC as well as percent purity by denaturing and non-denaturing SEC. The low percent recoveries observed for previous time points were no longer evident and values for percent recovery of insulin Aspart by RP-HPLC have increased slightly between 1 and 2 months for all temperatures (most evident at 30° C.).

c. Insulin Glulisine

All formulations were clear and colorless with no particles at all time points and temperatures. All of the formulations tested were stable within target specifications at 5±3° C. up to the 2 month time point for both rHuPH20 and insulin Glulisine.

All test articles were stable within target specifications at 15±2° C. at the 2 month time point for both rHuPH20 and insulin Glulisine. The 2 month data were generally slightly lower for rHuPH20 activity and recovery but percent purity remained the same, except in formulation #5 (no added methionine) which had a significantly lower percent purity at 2 months. Insulin glulisine was also stable within target specifications at 15° C. up to the 2 month time point, showing only slightly lower values after 2 months at 15° C. for percent purity and recovery.

The rHuPH20 activity was well above the preliminary specifications (<375 U/mL) for 3 of the 7 formulations (#2, #3 and #6) held at 25±2° C. out to 2 months and just above specifications for formulation #4. In general these formulations either contained the lower levels of preservative (#2 and #3) or higher salt and lower pH (#6). Formulation #4, which was just above the rHuPH20 activity specification, had the highest level of preservative and pH in the study but also contained a higher concentration of NaCl. There was downward trending for all of the formulations with respect to rHuPH20 activity, purity, and content. Insulin Glulisine was stable in all formulations at 25° C. out to the 2 month time point but the slight downward trend with respect to purity and percent recovery identified at 1 month continued.

The rHuPH20 was less stable in all of the formulations held at 30±2° C. as compared to those at 25±2° C. Only the USP preservative level formulation (#3) met the target activity specification of >375 U/mL after 2 months at 30° C. Formulation #3 also showed acceptable rHuPH20 purity and recovery at the 2 month time point. Insulin Glulisine was stable within target specifications for 2 months in all formulations at 30° C., but there was a clear downward trend noticeable for percent purity and percent recovery by RP-HPLC.

3. 3-Month Time Point a. Insulin Lispro

All formulations were stable at 5±3° C. up to the 3 month time point for both rHuPH20 and insulin lispro. The rHuPH20 purity by RP-HPLC had somewhat lower values than expected, but this appears to be due to normal assay variation. All formulations were clear and colorless with no particles at all time points and temperatures, except formulation A3 that was identified to contain "2 red foreign slivers".

All formulations met all target specifications at 15±2° C. up to the 3 month time point for both rHuPH20 and insulin lispro. The rHuPH20 purity by RP-HPLC also had somewhat lower values than expected, which as mentioned previously appears to be due to normal assay variation. There is some slight trending downward for rHuPH20 activity and insulin Lispro purity by non-denaturing SEC but no other obvious downward trending.

rHuPH20 was not stable in the commercial preservative formulations (A1-A4) at 25±2° C. out to 3 months. Four (4) of the 5 EP-B formulations (B1, B2, B3, and B5) were still above the 375 U/mL target specification for rHuPH20 enzymatic activity after 3 months at 25° C., and have downward trending but acceptable rHuPH20 purity and recovery. The USP formulation (U1) was still well above the rHuPH20 activity target specification after 3 months at 25° C. with a value of 522 U/mL and correspondingly high purity and recovery values. Insulin lispro was stable in all formulations at 25° C. out to the 3-month time, but downward trends for insulin lispro purity by RP-HPLC and non-denaturing SEC were apparent.

As identified previously, the rHuPH20 was less stable in all of the formulations held at 30±2° C. as compared to those at 25±2° C. and all formulations were below the target rHuPH20 activity specification after 3 months at 30° C. Insulin lispro was stable within the target specification for 3 months in all formulations at 30° C., but there are definite downward trends for percent purity by RP-HPLC as well as percent purity by non-denaturing SEC.

b. Insulin Aspart

All formulations were clear and colorless with no particles at all time points and temperatures. All of the tested formulations were stable at 5±3° C. up to the 3 month time point for both rHuPH20 and insulin Aspart. All formulations met all target specifications at 15±2° C. up to the 3 month time point for both rHuPH20 and insulin Aspart. There was some trending downward for rHuPH20 activity, purity, and recovery. Insulin Aspart purity by non-denaturing SEC was somewhat lower than at the 2-month time point, but it is not clear if this is a downward trend or normal assay variability.

rHuPH20 was not stable in the commercial preservative formulations but formulation A1 was only slightly below the target rHuPH20 activity specification (<375 U/mL) at 3 months (369 U/mL). Three (3) of the 5 EP-B formulations (B1, B2 and B3) were still well above the 375 U/mL target specification after 3 months at 25±2° C. and had acceptable but unexpectedly lower rHuPH20 purity and recovery as mentioned in the 2 month summary. The USP formulation (U1) was still well above the rHuPH20 activity target specification after 3 months at 25° C. with a value of 492 U/mL with acceptable purity and recoveries. Insulin Aspart was stable in all formulations at 25° C. out to the 3 month time point but there were clear downward trends in purity by RP-HPLC and non-denaturing SEC.

As previously discussed, rHuPH20 was less stable in all of the formulations held at 30±2° C. as compared to those at 25±2° C. All A and B formulations were below the target rHuPH20 activity specification by 1 month at 30° C. The USP formulation (U1) was only slightly below the intended >375 U/mL specification at 3 months (371 U/mL) but also had low rHuPH20 percent purity and percent recovery by RP-HPLC. Insulin aspart was stable within target specification for 3 months in all formulations at 30° C. by all techniques except non-denaturing SEC which showed a very slight decline to approximately 97% main peak for all formulations.

4. 6-Month Time Point a. Insulin Lispro

All formulations were clear and colorless with no particles at all time points and temperatures. Formulations at 30±2° C. were not evaluated at the 6 month time point.

All formulations were stable at 5±3° C. and 15±2° C. up to the 6 month time point for both rHuPH20 and insulin lispro. There was some slight trending downward for rHuPH20 activity and rHuPH20 percent recovery for all formulations. Formulation A4 was the least stable at both temperatures.

Only formulations B3 and U1 met the stability requirements at 25±2° C. Both of these formulations had a pH of 7.4 and 80 mM salt. The remaining formulations had rHuPH20 enzymatic activity less than 375 U/mL. The loss in activity coincided with a loss in rHuPH20 percent recovery. Non-denaturing SEC showed a slight downward trending in insulin lispro percent purity.

b. Insulin Aspart

All formulations were clear and colorless with no particles at all time points and temperatures. Formulations at 30±2° C. were not evaluated at the 6 month time point.

All formulations were stable at 5±3° C. and 15±2° C. up to the 6 month time point for both rHuPH20 and insulin aspart. There was some slight trending downward for rHuPH20 activity and rHuPH20 percent recovery for all formulations. Formulation A4 was the least stable at both temperatures.

Only formulation U1 met the stability requirements at 25±2° C. The remaining formulations had less rHuPH20 enzymatic activity less than 375 U/mL. The loss in activity coincided with a loss in rHuPH20 percent recovery. Non-denaturing SEC showed a slight downward trending in insulin aspart percent purity.

5. 9-Month Time Point a. Insulin Lispro

All formulations were clear and colorless with no particles at all time points and temperatures. Formulations at 25±2° C. and 30±2° C. were not evaluated at the 9 month time point.

All formulations were stable at 5±3° C. and 15±2° C. up to the 9 month time point for both rHuPH20 and insulin lispro. There is some slight trending downward for rHuPH20 activity and rHuPH20 percent recovery for all formulations. As was seen at 6 months, Formulation A4 is the least stable at both temperatures.

b. Insulin Aspart

All formulations were clear and colorless with no particles at all time points and temperatures. Formulations at 25±2° C. and 30±2° C. were not evaluated at the 9 month time point.

All formulations were stable at 5±3° C. and 15±2° C. up to the 9 month time point for both rHuPH20 and insulin aspart. There was some slight trending downward for rHuPH20 activity and rHuPH20 percent recovery for all formulations. As was seen at 6 months, Formulation A4 was the least stable at both temperatures.

Example 14

Accelerated Stability Study of Aspart-rHuPH20 and Lispro-rHuPH20: Freeze/Thaw, Agitation and High Storage Temperature In this example, the stability of various insulin Aspart-rHuPH20 and insulin Lispro-rHuPH20 formulations was evaluated under three physical accelerated stress conditions: multiple freeze/thaw cycles; agitation at 25° C., and thermal stress at 37° C. Stability was evaluated by measuring general appearance and characteristics, rHuPH20 enzymatic activity and rHuPH20 and insulin analog purity.

The insulin analog/rHuPH20 formulations are set forth in Table 64 below. A Humalog® sample (insulin Lispro, Formulation 4) and NovoLog® sample (insulin Aspart, Formulation 8) were used as controls. The base formulations contained 3.47 mg/mL insulin Lispro or 3.5 mg/mL insulin Aspart, 600 U/mL rHuPH20, 30 mM Tris/HCl, and 0.01% Poloxamer 188. Formulations 1 and 5 additionally contained 50 mM NaCl, 100 mM methionine, 0.13% phenol and 0.075% m-cresol, with a pH of 7.4. Formulations 2 and 6 (EP-B formulations) additionally contained 80 mM NaCl, 20 mM methionine and 50 mM glycerin with an EP-B preservative level: 0.15% phenol and 0.175% m-cresol. Formulations 3 and 7 (USP formulations) additionally contained 80 mM NaCl, 20 mM methionine and 50 mM glycerin with an USP preservative level: 0.13% phenol and 0.075% m-cresol.

Each formulation was exposed to the following accelerated degradation conditions:
(1) Agitation at 25° C.: Each formulation was kept in a 25° C. incubator equipped with a shaker. The vials stood upright with shaking at 650 rpm. Samples were withdrawn for analysis after shaking for 6, 12 and 24 hours. All samples were stored at 2-8° C. prior to analysis.
(2) Multi-Cycle Freeze/Thaw: Each formulation was subjected to 5 cycles of freeze/thaw by alternating the storage condition between a −30° C. freezer and room temperature at the bench. The samples were left at each condition for at least 2 hours for each cycle (i.e., 2 hours in −30° C. freezer, remove and place on bench top at room temperature for 2 hours was considered 1 cycle). Samples were withdrawn after 1, 3 and 5 cycles and stored at 2-8° C. prior to analysis.
(3) Thermal Stress: Each formulation was kept in a 37° C. incubator. Samples were withdrawn after 8, 24 and 48 hours and samples were stored at 2-8° C. prior to analysis.

Analysis was performed before and after the stress conditions were applied. All formulations were characterized by a complete set of analytical tests, including appearance, osmolality, pH, turbidity, hyaluronidase enzymatic activity, hyaluronidase purity, and insulin purity, HWM purity and content (see Examples 2-5 and 12 above for testing procedures). The stability acceptance criteria or target specification for each parameter tested are the same as described in Example 12. The results are summarized below.

1. Agitation at 25° C.

The EP-B formulations (#2 and #6) and the control formulations (#4 and #8) were clear and colorless with no particles at all time points. The UPS formulations (#3 and #7) were clear and colorless after 6 hours of agitation but precipitate had formed by the 12 hour time point. Formulations #1 and #5 had precipitate at the 6 hour time point.

rHuPH20 was stable in all formulations at all time points having >375 U/mL enzymatic activity. rHuPH20 percent recovery decreased slightly at all successive time points, but all formulations maintained an acceptable recovery level. Insulin Aspart and Insulin Lispro were stable at all time points. NovoLog® (insulin Aspart) and Humalog® (insulin Lispro) controls were stable at all time points.

TABLE 64

Insulin Formulations

| # | pH | Buffer | Tonicity Modifier | | Surfactant | Preservatives | | API | |
|---|----|--------|-------------------|--|------------|---------------|--|-----|--|
| 1 | 7.4 | 30 mM Tris/HCl | 50 mM NaCl | 100 mM Methionine | — | 0.01% Poloxamer 188 | 0.13% phenol | 0.075% m-cresol | 600 U/mL rHuPH20 | 3.47 mg/mL Lispro |
| 2 | 7.4 | 30 mM Tris/HCl | 80 mM NaCl | 20 mM Methionine | 50 mM Glycerin | 0.01% Poloxamer 188 | 0.15% phenol | 0.175% m-cresol | 600 U/mL rHuPH20 | 3.47 mg/mL Lispro |
| 3 | 7.4 | 30 mM Tris/HCl | 80 mM NaCl | 20 mM Methionine | 50 mM Glycerin | 0.01% Poloxamer 188 | 0.13% phenol | 0.075% m-cresol | 600 U/mL rHuPH20 | 3.47 mg/mL Lispro |
| 4 | 7.0-7.8 | — | — | — | — | — | — | 0.315% m-cresol | Humalog ® | |
| 5 | 7.4 | 30 mM Tris/HCl | 50 mM NaCl | 100 mM Methionine | — | 0.01% Poloxamer 188 | 0.13% phenol | 0.075% m-cresol | 600 U/mL rHuPH20 | 3.5 mg/mL Aspart |
| 6 | 7.2 | 30 mM Tris/HCl | 80 mM NaCl | 20 mM Methionine | 50 mM Glycerin | 0.01% Poloxamer 188 | 0.15% phenol | 0.175% m-cresol | 600 U/mL rHuPH20 | 3.5 mg/mL Aspart |
| 7 | 7.2 | 30 mM Tris/HCl | 80 mM NaCl | 20 mM Methionine | 50 mM Glycerin | 0.01% Poloxamer 188 | 0.13% phenol | 0.075% m-cresol | 600 U/mL rHuPH20 | 3.5 mg/mL Aspart |
| 8 | 7.2-7.6 | — | — | — | — | — | 0.15% phenol | 0.172 % m-cresol | Novolog ® | |

2. Freeze/Thaw

All formulations were clear and colorless with no particles at all time points. After 1 freeze/thaw cycle, rHuPH20 enzymatic activity was severely diminished (highest formulation, #3, had an activity of 168 U/mL), although the percent purity remained >95% for all formulations and time points. rHuPH20 percent recovery was below the acceptable levels for most of the formulations. Insulin Aspart and Insulin Lispro were stable at all time points. NovoLog® (insulin Aspart) and Humalog® (insulin Lispro) were stable at all time points.

3. Thermal Stress at 37° C.

All formulations were clear and colorless with no particles at all time points. Formulations #1, #3, #5 and #7 had acceptable rHuPH20 enzymatic activity (>375 U/mL) after 8 hours at 37° C. rHuPH20 stability decreased at all successive time points for all formulations, as evidenced by a decrease in rHuPH20 activity (below 375 U/mL) and a decrease in percent recovery. Insulin Aspart and Insulin Lispro were stable at all time points. NovoLog® (insulin Aspart) and Humalog® (insulin Lispro) controls were stable at all time points.

5 and #7 varied from formulation #3 in their pH and NaCl concentrations. Three additional formulations (#8-#10) were evaluated containing no methionine, and each containing 3.5 mg/mL insulin, 600 U/mL rHuPH20, 15 mg/mL HA oligomers, 30 mM Tris/HCl, 80 mM NaCl and 0.01% Poloxamer 188 with 0.1% phenol and 0.15% m-cresol at pH 7.4. Formulation #8 additionally contained 20 mM methionine and formulation #10 additionally contained 50 mM glycerin.

TABLE 65

Formulations containing 600 U/mL rHuPH20 and 3.5 mg/mL Insulin

| # | pH | Buffer | Tonicity Modifier | | Stabilizer | | Preservatives | | |
|---|---|---|---|---|---|---|---|---|---|
| 1 | 7.4 | 30 mM Tris/HCl | 80 mM NaCl | 50 mM Glycerin | | 20 mM Methionine | 0.01% F68 | 0.1% phenol | 0.15% m-cresol |
| 2 | 7.4 | 30 mM Tris/HCl | 80 mM NaCl | | 10 mg/mL HA | 20 mM Methionine | 0.01% F68 | 0.1% phenol | 0.15% m-cresol |
| 3 | 7.4 | 30 mM Tris/HCl | 80 mM NaCl | | 15 mg/mL HA | 20 mM Methionine | 0.01% F68 | 0.1% phenol | 0.15% m-cresol |
| 4 | 7.4 | 30 mM Tris/HCl | 80 mM NaCl | | 20 mg/mL HA | 20 mM Methionine | 0.01% F68 | 0.1% phenol | 0.15% m-cresol |
| 5 | 7.2 | 30 mM Tris/HCl | 80 mM NaCl | | 15 mg/mL HA | 20 mM Methionine | 0.01% F68 | 0.1% phenol | 0.15% m-cresol |
| 6 | 7.4 | 30 mM Tris/HCl | 80 mM NaCl | 50 mM Glycerin | 15 mg/mL HA | 20 mM Methionine | 0.01% F68 | 0.1% phenol | 0.15% m-cresol |
| 7 | 7.4 | 30 mM Tris/HCl | 100 mM NaCl | | 15 mg/mL HA | 20 mM Methionine | 0.01% F68 | 0.1% phenol | 0.15% m-cresol |
| 8 | 7.4 | 30 mM Tris/HCl | 80 mM NaCl | | 15 mg/mL HA | 20 mM Methionine | 0.01% F68 | 0.1% phenol | 0.15% m-cresol |
| 9 | 7.4 | 30 mM Tris/HCl | 80 mM NaCl | | 15 mg/mL HA | | 0.01% F68 | 0.1% phenol | 0.15% m-cresol |
| 10 | 7.4 | 30 mM Tris/HCl | 80 mM NaCl | 50 mM Glycerin | 15 mg/mL HA | | 0.01% F68 | 0.1% phenol | 0.15% m-cresol |

Example 15

Effect of HA Oligomers on Insulin/rHuPH20 Formulation Stability

In this example, the effect of the addition of HA oligomers on the stability of various insulin/rHuPH20 formulations was evaluated. First, tests were completed to evaluate the stability under four storage conditions: 5° C., 25° C., 30° C. and 35° C. over time. Second, the effect of HA oligomers on rHuPH20 stability in the presence of different preservatives was tested. Third, the stabilizing effect of different sizes of HA oligomers was evaluated for insulin aspart-rHuPH20 formulations.

A. Effect of HA Oligomers on Storage Stability

The formulations contained various amounts of HA (10, 15 or 20 mg/mL). Additional formulations contained 15 mg/mL HA with varying pH, glycerin and salt concentrations.

The insulin/rHuPH20 formulations are set forth in Table 65 below. The basic formulations contained 3.5 mg/mL insulin, 600 U/mL (5 µg/mL) rHuPH20, 30 mM Tris/HCl, 80 mM NaCl, 20 mM methionine and 0.01% Poloxamer 188 (Poloxamer 188) with 0.1% phenol and 0.15% m-cresol at pH 7.4. Formulations #2-#4 additionally contained 10, 15 and 20 mg/mL HA oligomers, respectively. Formulations #1 and #6 additionally contained 50 mM glycerin, with formulation #6 containing 15 mg/mL HA oligomers. Formulations One (1) mL of each formulation was stored in USP Type 1 borosilicate 2 mL glass vial with a chlorobutyl rubber stopper and an aluminum seal. Each formulation was incubated, individually, at 5±3° C., 25±2° C., 30±2° C. and 35±2° C. and stability measurements were recorded at time t=0, 2, 5, 7 and 9 days, 1 and 2 weeks, 1 month or 2 months. Stability was assessed by measuring pH, appearance, osmolality, rHuPH20 enzymatic activity, content of rHuPH20 by RP-HPLC, content of insulin by RP-HPLC, and the percent purity of insulin by non-denaturing SEC (see Examples 2-5 and Example 12). The stability acceptance criteria or target specification for each parameter tested are the same as described in Example 12.

1. 5° C.

All formulations containing at least 15 mg/mL HA oligomers contained visible particles after only 1 week at 5° C. The formulations containing only 10 mg/mL HA oligomers or no HA oligomers were clear, colorless and contained no particles after 2 weeks at 5° C., but particles were observed after 1 month. All of the tested formulations were stable at 5° C. up to the 2 month time point for rHuPH20. Insulin was unstable in formulations containing 20 mg/mL HA oligomers (#4), having lower pH (#5) and containing higher salt (#7), after only 1 month at 5° C.

2. 25° C.

Formulations #5 (low pH) and #7 (high salt) contained particles after only 1 week at 25° C. The remaining formulations were all clear and colorless and contained no particles. All of the tested formulations were stable at 25° C. up to the 2 month time point for both rHuPH20 and insulin.

3. 30° C.

Formulations #5 (low pH) and #7 (high salt) contained particles after only 1 week at 30° C. The remaining formulations were all clear and colorless and contained no particles. All formulations containing HA were stable for 1 month at 30° C. for rHuPH20. By the 2 month time point, rHuPH20 enzymatic activity had decreased below acceptable levels of 375 U/mL. Insulin was stable in all formulations at the 1 month time point, with a clear decrease in stability observed after 2 months at 25° C. The additional of HA oligomers had a clear positive effect on rHuPH20 stability at 25° C. without affecting the stability of insulin.

Formulations #8-#10 were tested for rHuPH20 oxidation at time zero and after 3 days at 25° C. Formulation #10 containing 50 mM glycerin exhibited increased oxidation after only 3 days at 25° C.

4. 35° C.

Formulations containing HA oligomers were stable for 2 days at 35° C. for rHuPH20. At 5 days, only formulations #3 and #5, containing 15 mg/mL HA oligomers, with varying pH, were stable for rHuPH20. rHuPH20 content was low in all formulations after only 2 days at 35° C. The addition of HA oligomers had a clear positive effect on rHuPH20 stability at 35° C. without affecting the stability of insulin.

B. Preservative Effects

1. USP Preservatives

In this example, the ability of HA oligomers to stabilize insulin aspart-rHuPH20 or insulin lispro-rHuPH20 formulations containing USP levels of preservatives was evaluated as determined by rHuPH20 enzymatic activity. Formulations F1-F7 were tested. The basic formulations contained 3.5 mg/mL insulin aspart or insulin lispro, 600 U/mL rHuPH20, 30 mM Tris/HCl, pH 7.4, 5 mM methionine, 0.01% Poloxamer 188, 0.125% phenol and 0.075% m-cresol. Formulation F1 did not contain Insulin Aspart. rHuPH20 enzymatic activity was measured as described in Example 2B above. The results are set forth in Tables 66-67 below. All formulations were stable at 5° C. for 3 or 6 days. All formulations containing HA, regardless of their pH and NaCl concentrations, had higher enzymatic activities than the same formulations that did not contain HA. As shown in Table 66 below, formulation F4 containing 10 mg/mL HA had higher rHuPH20 enzymatic activity over time at 37° C. as compared to formulations F2 and F3, which did not contain HA, either at the same or lower pH. For formulation F5 (see Table 67 below), which had a reduced concentration of NaCl, the addition of 10 mg/mL in the formulation limited loss of the rHuPH20 activity due to the lower NaCl concentration, which is destabilizing for rHuPH20 (see, e.g., F3).

TABLE 66

Enzymatic Activities for Insulin Aspart-PH20 Formulations

| | | NaCl | HA | 5° C. | rHuPH20 Enzymatic Activity (U/mL) 37° C. | | | | |
|---|---|---|---|---|---|---|---|---|---|
| Form # | pH | mM | mg/mL | 6 d | 2 d | 4 d | 6 d | 8 d | 12 d |
| F1 | 7.0 | 200 | 0 | 679 | 575 | 553 | 513 | 481 | 487 |
| F2 | 7.0 | 140 | 0 | 674 | 512 | 454 | 394 | 400 | 346 |
| F3 | 7.2 | 140 | 0 | 671 | 481 | 424 | 363 | 352 | 302 |
| F4 | 7.2 | 140 | 10 | 667 | 542 | 491 | 442 | 431 | 371 |
| F5 | 7.2 | 100 | 10 | 658 | 517 | 432 | 392 | 385 | 319 |

TABLE 67

Enzymatic Activities for Insulin Lispro-PH20 Formulations

| | | NaCl | HA | Activity (U/mL) 5° C. | 37° C. | | |
|---|---|---|---|---|---|---|---|
| Form # | pH | mM | mg/mL | 3 d | 3 d | 5 d | 7 d |
| F1 | 7.2 | 140 | 0 | 641 | 248 | 141 | 98 |
| F2 | 7.2 | 140 | 10 | 642 | 426 | 323 | 284 |
| F3 | 7.2 | 120 | 10 | 650 | 431 | 363 | 288 |
| F4 | 7.2 | 100 | 10 | 643 | 420 | 350 | 253 |
| F5 | 7.2 | 80 | 10 | 659 | 419 | 349 | 229 |
| F6 | 7.4 | 120 | 10 | 642 | 353 | 284 | 175 |
| F7 | 7.4 | 100 | 10 | 643 | 345 | 264 | 158 |

2. EP-B Level Preservative

In this example, the ability of HA oligomers to stabilize insulin-rHuPH20 formulations with EP-B levels of preservatives was evaluated as determined by rHuPH20 enzymatic activity. The basic formulations contained 3.5 mg/mL insulin, 600 U/mL rHuPH20, 30 mM Tris/HCl, pH 7.4, 20 mM methionine, 0.01% Poloxamer 188, 0.10% phenol and 0.15% m-cresol. rHuPH20 enzymatic activity was measured as described in Example 2B above. The results are set forth in Table 68 below. At 35° C., the formulations that contained HA (F2-F6) all had higher rHuPH20 enzymatic activities than formulation F1, which did not contain HA. At day 9, only about 10% of enzymatic activity was left for F1, whereas formulations F2-F6, depending on their pH, HA and NaCl concentrations, still had about 30% to 60% rHuPH20 enzymatic activity. Similar results were observed for these formulations incubated at 30° C. for a longer term stability study. As shown in Table 68 below, at the end of 3 months storage at 30° C., about 30% of rHuPH20 enzymatic activity remained for formulation F1 which did not contain HA; for all other formulations that contained HA, on average, slightly above 50% of rHuPH20 enzymatic activity remained.

At lower temperature, the rHuPH20 experienced less thermal stress which might explains the smaller difference with respect to relative enzymatic activity changes between formulations with and without HA. It is noted that under the same pH and NaCl conditions, rHuPH20 activity does not correlate with the HA concentration tested in this study. Due to the fact that HA is a substrate for rHuPH20, its stabilizing mechanism most likely links to specific enzyme-substrate binding effect. This interaction certainly is affected by the molar ratio between the two molecules. At certain substrate:enzyme ratio, the maximal stabilizing effect is reached and the addition of more HA does not further improve the activity. In this example, about 10 mg/mL of HA is necessary to stabilize 5 µg/mL rHuPH20.

TABLE 68

Enzymatic Activities for Insulin-PH20 Formulations

| | | | | Activity (U/mL) | | | | | | |
|---|---|---|---|---|---|---|---|---|---|---|
| | | NaCl | HA | 5° C. | 35° C. | | | 30° C. | | |
| Form # | pH | mM | mg/mL | 0 d | 2 d | 5 d | 9 d | 1 m | 2 m | 3 m |
| F1 | 7.4 | 80 | 0 | 592 | 254 | 170 | 64 | 358 | 239 | 194 |
| F2 | 7.4 | 80 | 10 | 604 | 434 | 365 | 209 | 465 | 342 | 296 |
| F3 | 7.4 | 80 | 15 | 559 | 444 | 380 | 269 | 463 | 348 | 288 |
| F4 | 7.4 | 80 | 20 | 556 | 438 | 364 | 287 | 459 | 323 | 286 |
| F5 | 7.2 | 80 | 15 | 559 | 471 | 397 | 326 | 504 | 365 | 312 |
| F6 | 7.4 | 100 | 15 | 556 | 457 | 312 | 278 | 461 | 365 | 299 |

C. Effect of Molecular Weight of HA on rHuPH20 Stabilization

In this example, the stabilizing effect of different sizes of HA oligomers was evaluated for insulin aspart-rHuPH20 formulations as determined by measuring rHuPH20 enzymatic activity. Three different molecular weight sodium hyaluronates were acquired from Lifecore Biomedical (Minnesota, USA): 6.4 kDa (Lot: GSP252-5-7), 74 kDa (Lot: GSP252-60-2) and 234.4 kDa (Lot:002799). Ten (10) mg of each HA was added to 1 mL of an insulin aspart-PH20 formulation that contained 100 U/mL insulin aspart, 5 μg/mL rHuPH20, 30 mM Tris/HCl, pH 7.4, 80 mM NaCl, 50 mM glycerol, 20 mM methionine, 0.01% Poloxamer 188, 0.10% phenol, and 0.15% m-cresol. A formulation that contained no HA also was included in the study as a control. These solutions were incubated at 5° C. and 37° C. for up to 9 days to assess the stabilizing effect of different sizes of HA on rHuPH20 enzymatic activity. rHuPH20 enzymatic activity was measured as described in Example 2B above.

The results are shown in Table 69 below. The insulin aspart-rHuPH20 formulation that did not contain HA (F1) was enzymatically inactive after 3 days incubation at 37° C. In contrast, formulations F2-F4 retained about 30-40% rHuPH20 enzymatic activity. In general, there was a trend that the smaller HA polymers seemed to provide a better protection than the bigger ones. This could possibly be due to HA size alone or to HA to rHuPH20 molar ratio.

TABLE 69

Effect of Molecular Weight of HA on rHuPH20 Enzymatic Activity

| | | | Activity (U/mL) | | | |
|---|---|---|---|---|---|---|
| | MW of HA, | 5° C. | 37° C. | | | |
| Formulation | kDa | 9 d | 3 d | 5 d | 7 d | 9 d |
| F1 | NA | 600 | 34 | 2 | −15 | −16 |
| F2 | 6.4 | 645 | 279 | 145 | 59 | 27 |

TABLE 69-continued

Effect of Molecular Weight of HA on rHuPH20 Enzymatic Activity

| | | | Activity (U/mL) | | | |
|---|---|---|---|---|---|---|
| | MW of HA, | 5° C. | 37° C. | | | |
| Formulation | kDa | 9 d | 3 d | 5 d | 7 d | 9 d |
| F3 | 74.0 | 585 | 211 | 94 | 30 | 10 |
| F4 | 234.4 | 575 | 161 | 52 | 5 | −6 |

Example 16

Stability Study of Insulin Aspart/rHuPH20 Formulations

In this example, various insulin Aspart/rHuPH20 formulations were evaluated for stability under two storage conditions, 30° C. and 37° C., and under accelerated conditions (agitation at 25° C. for 9 days). The tested insulin/rHuPH20 formulations are set forth in Table 70 below. The reference formulation (#7) contained 3.5 mg/mL insulin Aspart, 600 U/mL (5 μg/mL) rHuPH20, 30 mM Tris/HCl, 80 mM NaCl, 50 mM glycerin, 20 mM methionine and 0.01% Poloxamer 188 (Poloxamer 188) with 0.1% phenol and 0.15% m-cresol at pH 7.4. Formulations #1-#3 tested preservative levels of 0.13% phenol and 0.12% m-cresol with 3 different levels of stabilizer Poloxamer 188. Formulations #4-#6 tested preservative levels of 0.15% phenol and 0.12% m-cresol with 3 different levels of stabilizer Poloxamer 188. Formulations #8 and #9 additionally contained 10 mg/mL HA oligomers with formulation #8 having a lower level of glycerin (20 mM). Formulations #10 and #11 contained a lower level of methionine (5 mM) and #11 additionally contained 10 mg/mL HA oligomers.

TABLE 70

Formulations containing 600 U/mL rHuPH20 and 3.5 mg/mL Insulin Aspart

| # | pH | Buffer | Tonicity Modifier | | Stabilizer | | Preservatives | |
|---|---|---|---|---|---|---|---|---|
| 1 | 7.4 | 30 mM Tris/HCl | 80 mM NaCl | 50 mM Glycerin | 20 mM Methionine | 0.01% F68 | 0.13% phenol | 0.12% m-cresol |
| 2 | 7.4 | 30 mM Tris/HCl | 80 mM NaCl | 50 mM Glycerin | 20 mM Methionine | 0.05% F68 | 0.13% phenol | 0.12% m-cresol |

TABLE 70-continued

Formulations containing 600 U/mL rHuPH20 and 3.5 mg/mL Insulin Aspart

| # | pH | Buffer | Tonicity Modifier | Stabilizer | | | Preservatives | |
|---|----|--------|-------------------|------------|--|--|---------------|--|
| 3 | 7.4 | 30 mM Tris/HCl | 80 mM NaCl | 50 mM Glycerin | | 20 mM Methionine | 0.1% F68 | 0.13% phenol | 0.12% m-cresol |
| 4 | 7.4 | 30 mM Tris/HCl | 80 mM NaCl | 50 mM Glycerin | | 20 mM Methionine | 0.01% F68 | 0.15% phenol | 0.12% m-cresol |
| 5 | 7.4 | 30 mM Tris/HCl | 80 mM NaCl | 50 mM Glycerin | | 20 mM Methionine | 0.05% F68 | 0.15% phenol | 0.12% m-cresol |
| 6 | 7.4 | 30 mM Tris/HCl | 80 mM NaCl | 50 mM Glycerin | | 20 mM Methionine | 0.1% F68 | 0.15% phenol | 0.12% m-cresol |
| 7 | 7.4 | 30 mM Tris/HCl | 80 mM NaCl | 50 mM Glycerin | | 20 mM Methionine | 0.01% F68 | 0.1% phenol | 0.15% m-cresol |
| 8 | 7.4 | 30 mM Tris/HCl | 80 mM NaCl | 20 mM Glycerin | 10 mg/mL HA | 20 mM Methionine | 0.01% F68 | 0.1% phenol | 0.15% m-cresol |
| 9 | 7.4 | 30 mM Tris/HCl | 80 mM NaCl | 50 mM Glycerin | 10 mg/mL HA | 20 mM Methionine | 0.01% F68 | 0.1% phenol | 0.15% m-cresol |
| 10 | 7.4 | 30 mM Tris/HCl | 80 mM NaCl | 50 mM Glycerin | | 5 mM Methionine | 0.01% F68 | 0.1% phenol | 0.15% m-cresol |
| 11 | 7.4 | 30 mM Tris/HCl | 80 mM NaCl | 50 mM Glycerin | 10 mg/mL HA | 5 mM Methionine | 0.01% F68 | 0.1% phenol | 0.15% m-cresol |

One (1) mL of each formulation was stored in USP Type 1 borosilicate 2 mL glass vial with a chlorobutyl rubber stopper and an aluminum seal. Each formulation was incubated, individually, at 30±2° C. and 37±2° C. and stability measurements were recorded at time t=0, 2, 4, 7 and 9 days, 2 weeks, 1 month or 1.5 months. For each formulation, one set of vials was subjected to agitation using a Titer Plate shaker (LabLine) at 600 rpm for 9 days at 25° C. NovoLog® (insulin Aspart) was also subjected to the same agitation conditions as a control.

Stability was assessed by measuring pH, appearance, osmolality, rHuPH20 enzymatic activity, content of rHuPH20 by RP-HPLC and content of insulin by RP-HPLC (see Examples 2-5 and 12). The acceptable criteria or target specification for the stability parameters was the same as set forth in Example 12.

1. 30° C.

All formulations were all clear and colorless and contained no particles after 2 weeks at 30° C. All of the tested formulations were stable at 30° C. up to the 2 week time point for both rHuPH20 and insulin Aspart, with a slight downward trend in stability observed for all formulations over time. A stabilizing effect on rHuPH20 activity was observed for formulations containing HA oligomers (#8, #9, #11) as evidenced by higher enzymatic activity and content as compared to the formulations that did not contain HA oligomers. Additionally, a decrease in either the glycerin and methionine concentrations did not result in a visible effect on the stability of these formulations (#8, #9, and #11).

A comparison of preservative concentrations indicated that decreasing the amount of metacresol and a modest increase in the amount of phenol is beneficial for rHuPH20 stability, but the benefit is eliminated when the concentration of phenol is high. In contrast, changes in preservative concentrations had little effect on insulin Aspart stability, as a modest decrease in insulin Aspart content was observed for all formulations. For example, rHuPH20 was more stable in formulations containing 0.13% phenol (#1-#3) than those containing 0.15% phenol (#4-#6). Formulations containing increased phenol concentrations and decreased metacresol concentrations (#1-#3) were more stable than the reference formulation (#7) that contained a lower amount of phenol and a higher amount of metacresol. In contrast, formulations #4-#6 were as stable as reference formulation #7.

2. 37° C.

All formulations were all clear and colorless and contained no particles after 9 days at 37° C. A stabilizing effect on rHuPH20 activity was observed for formulations containing HA oligomers (#8, #9, and #11) as evidenced by higher enzymatic activity and content after 2 days at 37° C. as compared to the formulations that did not contain HA oligomers, although none of the formulations had an acceptable level of rHuPH20 enzymatic activity. Loss of rHuPH20 enzymatic activity was associated with loss of rHuPH20 content. In contrast, insulin Aspart content showed a downward trend for formulations containing HA oligomers indicating insulin Aspart is not as stable at 37° C. in the presence of HA oligomers.

Similar to the effects seen at 25° C., a comparison of preservative concentrations indicated that decreasing the amount of metacresol and a modest increase in the amount of phenol is beneficial for rHuPH20 stability, but the benefit is eliminated when the concentration of phenol is high. In contrast, changes in preservative concentrations had little effect on insulin Aspart stability, as a modest decrease in insulin content was observed for all formulations.

3. Agitation at 25° C.

rHuPH20 and insulin Aspart were stable in all formulations after 24 or 48 hours at 25° C. with agitation, although formulations containing HA oligomers (#8, #9, and #11) were cloudy after 24 hours. Novolog® was stable after 24 hours at 25° C. with agitation. Changes in preservative concentrations had no effect on rHuPH20 or insulin Aspart stability.

Example 17

Formulations Containing HA Oligomers and Divalent Metal Ion ($Mg^{2+}$)

In this example, the effect of EP-B levels of preservatives on rHuPH20 enzymatic activity was evaluated under two storage conditions: 5° C. at 5 days and 37° C. for 3-5 days. The formulations contained differing amounts of HA oligomers and divalent metal ion ($Mg^{2+}$).

The rHuPH20 formulations are set forth in Table 71 below. The basic formulations contained 600 U/mL rHuPH20, 30 mM Tris/HCl, 200 mM NaCl, 5 mM methionine, 0.01% Poloxamer 188 (Poloxamer 188) with 0.100% phenol and 0.150% m-cresol at pH 6.8. Formulations 2 and 4 additionally contained 10 mg/mL HA oligomers and formulations 3 and 5 contained 20 mg/mL HA oligomers. Formulations 2 and 3 additionally contained 3 mM $Mg^{2+}$ and formulations 4 and 5 contained 10 mM $Mg^{2+}$.

TABLE 71

Formulations containing 600 U/mL rHuPH20

| # | pH | Buffer | Tonicity Modifier | Stabilizer | | | Metal Ion | Preservatives | |
|---|---|---|---|---|---|---|---|---|---|
| 1 | 6.8 | 30 mM Tris/HCl | 200 mM NaCl | — | 5 mM Methionine | 0.01% F68 | — | 0.100% phenol | 0.150% m-cresol |
| 2 | 6.8 | 30 mM Tris/HCl | 200 mM NaCl | 10 mg/mL HA | 5 mM Methionine | 0.01% F68 | 3 mM $Mg^{++}$ | 0.100% phenol | 0.150% m-cresol |
| 3 | 6.8 | 30 mM Tris/HCl | 200 mM NaCl | 20 mg/mL HA | 5 mM Methionine | 0.01% F68 | 3 mM $Mg^{++}$ | 0.100% phenol | 0.150% m-cresol |
| 4 | 6.8 | 30 mM Tris/HCl | 200 mM NaCl | 10 mg/mL HA | 5 mM Methionine | 0.01% F68 | 10 mM $Mg^{++}$ | 0.100% phenol | 0.150% m-cresol |
| 5 | 6.8 | 30 mM Tris/HCl | 200 mM NaCl | 20 mg/mL HA | 5 mM Methionine | 0.01% F68 | 10 mM $Mg^{++}$ | 0.100% phenol | 0.150% m-cresol |

One (1) mL of each formulation was stored in USP Type 1 borosilicate 2 mL glass vial with a chlorobutyl rubber stopper and an aluminum seal. Each formulation was incubated, individually, at 5 and 37° C. and stability measurements were recorded at time t=3, 4 and/or 5 days. Stability was assessed by measuring pH, appearance, osmolality, rHuPH20 enzymatic activity and content of rHuPH20 by RP-HPLC (see Examples 2-3 and 5 and Example 12). The acceptance criteria or target specification for each of the above parameters is the same as set forth in Example 12.

The results show that all formulations were clear and colorless with no particles. Osmolarity tended to increase with the addition of $Mg^{2+}$. rHuPH20 enzymatic activity and content was stable at 5° C. for all formulations. At 37° C., rHuPH20 enzymatic activity was decreased at 3 days and after 4 days, was at the accepted target specification of 375 U/mL. After 5 days, approximately half of the initial rHuPH20 enzymatic activity remained. Drop in activity correlated with drop in rHuPH20 content.

Example 18

Study of USP Preservative Formulations at 5° C. or 37° C.

In this example, the effect of USP levels of preservatives on rHuPH20 enzymatic activity was evaluated under two storage conditions: 5° C. at 4 days and 37° C. for 2, 4, 6, 8 and 12 days. The formulations contained differing amounts of HA oligomers and salt and varying pH. The rHuPH20 formulations are set forth in Table 72 below. The basic formulations contained 600 U/mL rHuPH20, 3.5 mg/mL insulin aspart, insulin lispro or regular insulin, 30 mM Tris/HCl, 5 mM methionine, 0.01% Poloxamer 188 (Poloxamer 188) with 0.125% phenol and 0.075% m-cresol. Formulation 1 did not contain insulin. Formulations 2-5 contained insulin aspart, formulations 6-9 contained regular insulin and formulations 10-13 contained insulin lispro. Four basic formulations were prepared for each insulin analog. Formulations 2, 6 and 10 were the same as 3, 7 and 11, respectively, with varying pH (7.0 versus 7.2). Formulations 3, 8 and 12 were the same as 4, 9 and 13, respectively, with varying NaCl. These formulations additionally contained 10 mg/mL HA oligomers.

TABLE 72

Formulations

| # | pH | Buffer | Tonicity Modifier | Stabilizer | | | Preservatives | | rHuPH20 | insulin |
|---|---|---|---|---|---|---|---|---|---|---|
| 1 | 7.0 | 30 mM Tris/HCl | 200 mM NaCl | — | 5 mM Methionine | 0.01% F68 | 0.125% phenol | 0.075% m-cresol | 600 U/mL | — |
| 2 | 7.0 | 30 mM Tris/HCl | 140 mM NaCl | — | 5 mM Methionine | 0.01% F68 | 0.125% phenol | 0.075% m-cresol | 600 U/mL | 3.5 mg/mL Aspart |
| 3 | 7.2 | 30 mM Tris/HCl | 140 mM NaCl | — | 5 mM Methionine | 0.01% F68 | 0.125% phenol | 0.075% m-cresol | 600 U/mL | 3.5 mg/mL Aspart |
| 4 | 7.2 | 30 mM Tris/HCl | 140 mM NaCl | 10 mg/mL HA | 5 mM Methionine | 0.01% F68 | 0.125% phenol | 0.075% m-cresol | 600 U/mL | 3.5 mg/mL Aspart |

TABLE 72-continued

Formulations

| # | pH | Buffer | Tonicity Modifier | Stabilizer | | Preservatives | | rHuPH20 | insulin |
|---|----|--------|-------------------|------------|---|---------------|---|---------|---------|
| 5 | 7.2 | 30 mM Tris/HCl | 100 mM NaCl | 10 mg/mL HA | 5 mM Methionine | 0.01% F68 | 0.125% phenol | 0.075% m-cresol | 600 U/mL | 3.5 mg/mL Aspart |
| 6 | 7.0 | 30 mM Tris/HCl | 140 mM NaCl | — | 5 mM Methionine | 0.01% F68 | 0.125% phenol | 0.075% m-cresol | 600 U/mL | 3.5 mg/mL Insulin |
| 7 | 7.2 | 30 mM Tris/HCl | 140 mM NaCl | — | 5 mM Methionine | 0.01% F68 | 0.125% phenol | 0.075% m-cresol | 600 U/mL | 3.5 mg/mL Insulin |
| 8 | 7.2 | 30 mM Tris/HCl | 140 mM NaCl | 10 mg/mL HA | 5 mM Methionine | 0.01% F68 | 0.125% phenol | 0.075% m-cresol | 600 U/mL | 3.5 mg/mL Insulin |
| 9 | 7.2 | 30 mM Tris/HCl | 100 mM NaCl | 10 mg/mL HA | 5 mM Methionine | 0.01% F68 | 0.125% phenol | 0.075% m-cresol | 600 U/mL | 3.5 mg/mL Insulin |
| 10 | 7.0 | 30 mM Tris/HCl | 140 mM NaCl | — | 5 mM Methionine | 0.01% F68 | 0.125% phenol | 0.075% m-cresol | 600 U/mL | 3.5 mg/mL Lispro |
| 11 | 7.2 | 30 mM Tris/HCl | 140 mM NaCl | — | 5 mM Methionine | 0.01% F68 | 0.125% phenol | 0.075% m-cresol | 600 U/mL | 3.5 mg/mL Lispro |
| 12 | 7.2 | 30 mM Tris/HCl | 140 mM NaCl | 10 mg/mL HA | 5 mM Methionine | 0.01% F68 | 0.125% phenol | 0.075% m-cresol | 600 U/mL | 3.5 mg/mL Lispro |
| 13 | 7.2 | 30 mM Tris/HCl | 100 mM NaCl | 10 mg/mL HA | 5 mM Methionine | 0.01% F68 | 0.125% phenol | 0.075% m-cresol | 600 U/mL | 3.5 mg/mL Lispro |

One (1) mL of each formulation was stored in USP Type 1 borosilicate 2 mL glass vial with a chlorobutyl rubber stopper and an aluminum seal. Each formulation was incubated, individually, at 5 and 37° C. and stability measurements were recorded at time t=2, 4, 6, 8 and/or 12 days. Stability was assessed by measuring pH, appearance, osmolality, rHuPH20 enzymatic activity, content of rHuPH20 by RP-HPLC and content of insulin by RP-HPLC (see Examples 2-3, 5 and 12). The acceptable criteria and target specification for stability in each of the parameters tested was the same as set forth in Example 12.

The results show that formulation 1 and all of the insulin aspart formulations (#2-5) were clear and colorless with no particles after 12 days at either 5 or 37° C. Crystals were observed in formulations 6 and 8-9 and 11-13 after 6 days at 5° C. and crystals were observed in formulation 10 after just 2 days at 5° C.

All of the formulations were stable after 4 days at 5° C. The insulin lispro formulations (#10-13) were stable for 8 days at 37° C. whereas the insulin formulations (#6-9) were stable for only 2 days (with the exception of #7) at 37° C. The insulin aspart formulations (#2-5) were stable for 4-6 days at 37° C. rHuPH20 content decreased over time for all formulations at 37° C. Insulin content decreased over time for all formulations.

Example 19

Antimicrobial Effectiveness Tests of Different Preservative Levels

In this example, several batches of formulations containing different levels of preservatives with targeted amounts of insulin and rHuPH20 were prepared for microbial effectiveness testing. The tests were performed according to the guidance of EP and USP by a contract analytical laboratory (Quadrants Scientific, Inc., San Diego, Calif. and Lancaster Laboratories, Lancaster, Pa.). The various preservative containing formulations were tested for anti-microbial effectiveness against bacteria *Pseudomonas aeruginosa, E. coli* and *Staphylococcus aureus* and fungi *Aspergillus niger* and *Candida albicans*. Tests were conducted by 1) adding an initial inoculum (at least $10^5$ CFU/mL) of each bacteria to the sample and 2) measuring the CFU/mL of each bacteria or fungi at 24 hours, 7 days and 14 days. Raw data (CFU/mL) was converted to a log 10 unit reduction from the measured inoculum. The formulations were tested at a temperature of 37° C.

All formulations contained 100 U/mL insulin or insulin analog and 5 μg/mL rHuPH20. The remaining components varied among the formulations such that the effect of various components could be compared. The results are summarized in Table 73, which summarizes the effects of the various formulation components on antimicrobial effectiveness. A neutral effect indicates the indicated component and concentrations have no effect on antimicrobial effectiveness. For example, insulin analog has a neutral effect on antimicrobial effectiveness, when comparing two formulations that vary only in the insulin analog, i.e., insulin aspart or insulin lispro. NaCl concentration had either a neutral or negative effect on antimicrobial effectiveness depending on the formulations.

TABLE 73

Summary of antimicrobial effectiveness testing

| | Concentration | Effect |
|---|---------------|--------|
| Insulin vs analog | | Insufficient data |
| Aspart vs Lispro | | Neutral |
| pH | (7.2-7.4) | Neutral |
| Methionine | (50-100 mM) | Neutral |
| | (20-50 mM) | Insufficient data |
| NaCl | (50-100 mM) | Negative |
| | (50-100 mM) | Neutral |
| | (80-100 mM) | Neutral |

TABLE 73-continued

Summary of antimicrobial effectiveness testing

| | Concentration | Effect |
|---|---|---|
| F68 | (0.01-0.03%) | Neutral |
| | (0.01-0.03%) | Slightly negative |
| Glycerol | (0-50 mM) | Insufficient data |
| Company | (Quadrant vs Lancaster) | Neutral |

Example 20

Generation of a Soluble rHuPH20-Expressing Cell Line

The HZ24 plasmid (set forth in SEQ ID NO:52) was used to transfect Chinese Hamster Ovary (CHO cells) (see e.g. U.S. Pat. Nos. 776,429 and 7,781,607 and U.S. Publication No. 2006-0104968). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:1, followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO:3) and amino acids 1-186 of mouse dihydrofolate reductase (set forth in SEQ ID NO:53), separated by the internal ribosomal entry site (IRES).

Non-transfected DG44 CHO cells growing in GIBCO Modified CD-CHO media for DHFR(−) cells, supplemented with 4 mM Glutamine and 18 ml/L Plurionic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected DG44 CHO cells were tested for viability prior to transfection.

Sixty million viable cells of the non-transfected DG44 CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 µg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 µF or at 350 V and 960 µF.

The cells were removed from the cuvettes after electroporation and transferred into 5 mL of Modified CD-CHO media for DHFR(−) cells, supplemented with 4 mM Glutamine and 18 ml/L Plurionic F68/L (Gibco), and allowed to grow in a well of a E-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity, using the microturbidity assay described in Example 2.

TABLE 74

Initial Hyaluronidase Activity of HZ24 Transfected DG44 CHO cells at 40 hours post-transfection

| | Dilution | Activity (Units/ml) |
|---|---|---|
| Transfection 1 330 V | 1 to 10 | 0.25 |
| Transfection 2 350 V | 1 to 10 | 0.52 |
| Negative Control | 1 to 10 | 0.015 |

Cells from Transfection 2 (350V) were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate.

TABLE 75

Hyaluronidase activity of identified clones

| Plate/Well ID | Relative Hyaluronidase |
|---|---|
| 1C3 | 261 |
| 2C2 | 261 |
| 3D3 | 261 |
| 3E5 | 243 |
| 3C6 | 174 |
| 2G8 | 103 |
| 1B9 | 304 |
| 2D9 | 273 |
| 4D10 | 302 |

Six HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment. Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate giving rise to clones producing in excess of 1,000 Units/ml in shaker flasks (clone 3D35M; or Gen1 3D35M). A master cell bank (MCB) of the 3D35M cells was then prepared.

Example 21
Production Gen2 Cells Containing Soluble Human PH20 (rHuPH20)

The Gen1 3D35M cell line described in Example 20 was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the 12$^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the 8$^{th}$ passage in medium containing 20.0 µM methotrexate were cloned out by limiting dilution in 96-well tissue culture plates containing CD C140 medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr-) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~43.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:56) was identical to the reference sequence (SEQ ID NO:49) except for one base pair difference at position 1131, which was observed to be a thymidine (T) instead of the expected cytosine (C). This is a silent mutation, with no effect on the amino acid sequence.

Example 22
A. Production of Gen2 Soluble rHuPH20 in 300 L Bioreactor Cell Culture A vial of HZ24-2B2 was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, the a vial of cells was thawed in a 37° C. water bath, media was added and the cells were centrifuged. The cells were resuspended in a 125 mL shake flask with 20 mL of fresh media and placed in a 37° C., 7% CO, incubator. The cells were expanded up to 40 mL in the 125 mL shake flask. When the cell density reached greater than 1.5×10$^6$ cells/mL, the culture was expanded into a 125 mL spinner flask in a 100 mL culture volume. The flask was incubated at 37° C., 7% $CO_2$. When the cell density reached greater than 1.5×10$^6$ cells/mL, the culture was expanded into a 250 mL spinner flask in 200 mL culture volume, and the flask was incubated at 37° C., 7% $CO_2$. When the cell density reached greater than 1.5×10$^6$ cells/mL, the culture was expanded into a 1 L spinner flask in 800 mL culture volume and incubated at 37° C., 7% $CO_2$. When the cell density reached greater than 1.5×10$^6$ cells/mL the culture was expanded into a 6 L spinner flask in 5000 mL culture volume and incubated at 37° C., 7% $CO_2$. When the cell density reached greater than 1.5×106 cells/mL the culture was expanded into a 36 L spinner flask in 32 L culture volume and incubated at 37° C., 7%

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of 4.0×10$^5$ viable cells per ml and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (lx CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for *mycoplasma*, bioburden, endotoxin and virus in vitro and in vivo, by Transmission Electron Microscopy (TEM) and enzyme activity.

The culture was pumped by a peristaltic pump through four Millistak filtration system modules (Millipore) in parallel, each containing a layer of diatomaceous earth graded to 4-8 µm and a layer of diatomaceous earth graded to 1.4-1.1 µm, followed by a cellulose membrane, then through a second single Millistak filtration system (Millipore) containing a layer of diatomaceous earth graded to 0.4-0.11 µm and a layer of diatomaceous earth graded to <0.1 µm, followed by a cellulose membrane, and then through a 0.22 µm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filter (Sartorius), followed by a 10× buffer exchange with 10 mM Tris, 20 mM $Na_2SO_4$, pH 7.5 into a 0.22 µm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. Following viral inactivation, the concentrated, diafiltered harvest was loaded onto the Q column at a flow rate of 100 cm/hr. The column was washed with 5 column volumes of 10 mM Tris, 20 mM $Na_2SO_4$, pH 7.5 and 10 mM Hepes, 50 mM NaCl, pH 7.0. The protein was eluted with 10 mM Hepes, 400 mM NaCl, pH 7.0 into a 0.22 μm final filter into sterile bag. The eluate sample was tested for bioburden, protein concentration and hyaluronidase activity. $A_{280}$ absorbance reading were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL) assay). The column was equilibrated with 5 column volumes of 5 mM potassium phosphate, 0.5 M ammonium sulfate, 0.1 mM CaCl2, pH 7.0. The protein eluate from the Q sepharose column was supplemented with 2M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM CaCl2 pH 7.0 at 100 cm/hr and the wash was added to the collected flow thru. Combined with the column wash, the flow through was passed through a 0.22 μm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL) assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and test for pH, conductivity and endotoxin (LAL) assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

The protein in the filtrate was then concentrated to 10 mg/mL using a 10 kD molecular weight cut off (MWCO) Sartocon Slice tangential flow filtration (TFF) system (Sartorius). The filter was first prepared by washing with 10 mM histidine, 130 mM NaCl, pH 6.0 and the permeate was sampled for pH and conductivity. Following concentration, the concentrated protein was sampled and tested for protein concentration and enzyme activity. A 6× buffer exchange was performed on the concentrated protein into the final buffer: 10 mM histidine, 130 mM NaCl, pH 6.0. Following buffer exchange, the concentrated protein was passed though a 0.22 μm filter into a 20 L sterile storage bag. The protein was sampled and tested for protein concentration, enzyme activity, free sulfhydryl groups, oligosaccharide profiling and osmolality.

The sterile filtered bulk protein was then aseptically dispensed at 20 mL into 30 mL sterile Teflon vials (Nalgene). The vials were then flash frozen and stored at −20±5° C.

Example 23

Effect of Lysyl Lysine as a Stabilizer for rHuPH20

Lysyl lysine (Lys-Lys or dilysine) was tested for its ability to stabilize rHuPH20 at elevated temperatures. Eight formulations were prepared as described in Table 76 below. As a control, Hylenex™ (containing 167 U/mL rHuPH20, 12.5 mM $Na_2PO_4$, 145 mM NaCl, 1 mg/mL HSA, 2.7 mM $CaCl_2$, 0.1% EDTA pH 7.4; designated F1) was tested. The remaining formulations were generated to contain 170 U/mL rHuPH20, 0.01% Tween 80 and various excipients/stabilizers as set forth in Table 76. To each tested formulation, Lys-Lys dihydrochloride (H-Lys-Lys-OH HCl; RnD Chem #G-2675) was added at a concentration of either 50, 100 or 150 mM. Since Lys-Lys was used as a chloride salt, the osmolality varied between the compositions, as seen in Table 76 below.

All formulations were filled into 2 mL USP type I borosilicate glass vials with 13 mm 4432/50 gray rubber stoppers and sealed with alumina seals. The vials were incubated at three different temperatures, 5° C., 25° C. and 40° C. for up to 3 months. Samples were tested at time 0, 1 week, 2 weeks, 1 month, 2 months and 3 months, depending on the temperature (see Tables 77-79). At each testing point, samples were removed from the incubators and tested for hyaluronidase activity as described in Example 2.

TABLE 76

| | | | | Formulations | | | | |
|---|---|---|---|---|---|---|---|---|
| Form. | PH20 U/mL | NaCl mM | $Na_2PO_4$ mM | Lys-Lys•2 HCl mM | TW80 % | Methionine mM | pH | mOsm |
| F1 Hylenex ™ | 167 U/mL PH20, 12.5 mM $Na_2PO_4$, 145 mM NaCl, 1 mg/mL HSA, 2.7 mM $CaCl_2$, 0.1% EDTA pH 7.4 | | | | | | | NA |
| F2 | 170 | 150 | 12.5 | none | 0.01 | 10 | 7.0 | 316 |
| F3 | 170 | 100 | 12.5 | 50 | 0.01 | 10 | 7.0 | 364 |

TABLE 76-continued

| Form. | PH20 U/mL | NaCl mM | Na$_2$PO$_4$ mM | Lys-Lys•2 HCl mM | TW80 % | Methionine mM | pH | mOsm |
|---|---|---|---|---|---|---|---|---|
| F4 | 170 | 50 | 12.5 | 100 | 0.01 | 10 | 7.0 | 419 |
| F5 | 170 | NA | NA | 100 | 0.01 | 10 | 7.0 | 444 |
| F6 | 170 | NA | NA | 150 | 0.01 | 10 | 6.5 | 446 |
| F7 | 170 | NA | NA | 150 | 0.01 | none | 7.0 | 449 |
| F8 | 170 | NA | NA | 100 | 0.01 | 10 | 7.0 | 300 |

The results are shown in Tables 77-79 below, which set forth the hyaluronidase activity in U/mL. For samples stored at 5° C. or 25° C., small decreases in the activity of rHuPH20 were observed, but all samples maintained at least 135 U/mL hyaluronidase activity (Tables 77 and 78). Further, no significant differences in hyaluronidase activity were observed between compositions containing Lys-Lys and compositions that did not contain Lys-Lys. For samples stored at 40° C., all samples had decreased enzymatic activity over time. Formulations F1 and F2 that did not contain Lys-Lys had the largest decrease in hyaluronidase activity. After 2 weeks at 40° C., the activity of formulations F1 and F2 was below 135 U/mL. Formulations containing Lys-Lys, at any concentration, all maintained their activity above 135 U/mL for at least 1 month at 40° C.

TABLE 77

Hyaluronidase activity (U/mL) of rHuPH20 at 5° C.

| Form. | Incubation Time, Months | | | |
|---|---|---|---|---|
| | 0 | 1 | 2 | 3 |
| F1 | 172 | 169 | 168 | 160 |
| F2 | 170 | 162 | 162 | 150 |
| F3 | 169 | 163 | 161 | 153 |
| F4 | 165 | 158 | 158 | 152 |
| F5 | 161 | 156 | 160 | 148 |
| F6 | 170 | 163 | 164 | 157 |
| F7 | 163 | 161 | 159 | 149 |
| F8 | 177 | 174 | 169 | 161 |

TABLE 78

Hyaluronidase activity (U/mL) of rHuPH20 at 25° C.

| Form. | Incubation Time, Months | | | | |
|---|---|---|---|---|---|
| | 0 | 0.5 | 1 | 2 | 3 |
| F1 | 172 | 176 | 168 | 157 | 161 |
| F2 | 170 | 170 | 162 | 144 | 145 |
| F3 | 169 | 162 | 162 | 151 | 152 |
| F4 | 165 | 165 | 161 | 150 | 147 |
| F5 | 161 | 161 | 162 | 160 | 159 |
| F6 | 170 | 175 | 169 | 169 | 164 |
| F7 | 163 | 159 | 155 | 152 | 156 |
| F8 | 177 | 174 | 170 | 167 | 165 |

TABLE 79

Hyaluronidase activity (U/mL) of rHuPH20 at 40° C.

| Form. | Incubation Time, Months | | | | | |
|---|---|---|---|---|---|---|
| | 0 | 0.25 | 0.5 | 1 | 2 | 3 |
| F1 | 172 | 137 | 127 | 85 | 46 | 33 |
| F2 | 170 | 133 | 114 | 98 | 63 | 53 |
| F3 | 169 | 162 | 158 | 141 | 113 | 100 |

TABLE 79-continued

Hyaluronidase activity (U/mL) of rHuPH20 at 40° C.

| Form. | Incubation Time, Months | | | | | |
|---|---|---|---|---|---|---|
| | 0 | 0.25 | 0.5 | 1 | 2 | 3 |
| F4 | 165 | 160 | 155 | 138 | 110 | 96 |
| F5 | 161 | 160 | 156 | 139 | 125 | 126 |
| F6 | 170 | 167 | 162 | 158 | 141 | 137 |
| F7 | 163 | 157 | 152 | 139 | 121 | 113 |
| F8 | 177 | 171 | 170 | 149 | 117 | 128 |

Example 24

Effect of Low Concentrations of Lysyl Lysine on rHuPH20 Stability

Various rHuPH20 formulations were tested for effects of low concentrations of lysyl lysine and pH on the activity of rHuPH20 at elevated temperatures. Three different Lys-Lys concentrations (10, 30 and 50 mM) and three different pH (6.5, 7.0 and 7.5) were evaluated, generating a total of 9 samples. The tested formulations are set forth in Table 80 below. As a control, Hylenex™ (set forth in Example 23; F1) was tested. Formulations F2 to F10 were all generated to target around 160 U/mL rHuPH20, 10 mM L-methionine (Spectrum #M1441), and 0.01% polysorbate 80 (Baker #4117-04) and various amounts of H-Lys-Lys-OH HCl (RnD Chem #G-2675) and NaCl (Baker #3628). 1N NaOH (EMD #SX0607H-6) was used to adjust the pH. The NaCl concentration was adjusted so all formulations had approximately the same osmolality (300 mOsm/Kg). All formulations were sterile filtered though a 0.2 micron filter.

All formulations were filled at 0.5 mL per vial into 2 mL USP type I borosilicate glass vials with 13 mm 4432/50 gray rubber stoppers and sealed with alumina seals. The vials were incubated at 40° C. for up to 8 weeks. Samples were tested at time 0, and 1, 2, 3, 4, and 8 weeks. At each testing point, samples were removed from the incubators and tested for hyaluronidase activity as described in Example 2.

TABLE 80

Formulations

| Form. | Lys-Lys mM | Met mM | NaCl mM | PS80 % | pH | Osmolality mOsm/Kg |
|---|---|---|---|---|---|---|
| F1 Hylenex ™ | 167 U/mL PH20, 12.5 mM Na$_2$PO$_4$, 145 mM NaCl, 1 mg/mL HSA, 2.7 mM CaCl$_2$, 0.1% EDTA pH 7.4 | | | | 7.40 | ND |
| F2 | 50 | 10 | 97 | 0.01 | 7.01 | 302 |
| F3 | 30 | 10 | 117 | 0.01 | 7.51 | 305 |
| F4 | 50 | 10 | 99 | 0.01 | 6.54 | 304 |
| F5 | 10 | 10 | 147 | 0.01 | 6.52 | 305 |
| F6 | 50 | 10 | 91 | 0.01 | 7.52 | 306 |

TABLE 80-continued

| Form. | Lys-Lys mM | Met mM | NaCl mM | PS80 % | pH | Osmolality mOsm/Kg |
|---|---|---|---|---|---|---|
| F7 | 10 | 10 | 145 | 0.01 | 7.52 | 309 |
| F8 | 30 | 10 | 121 | 0.01 | 6.54 | 306 |
| F9 | 10 | 10 | 147 | 0.01 | 7.01 | 310 |
| F10 | 30 | 10 | 122 | 0.01 | 7.02 | 304 |

The results are shown in Table 81 below, which sets forth the hyaluronidase activity in U/mL and the ratio of the activity as compared to time 0. Formulations F2-F9, all containing Lys-Lys, showed improved rHuPH20 stability over reference formula F1, regardless of pH. No significant difference was observed among samples containing 10, 30 or 50 mM Lys-Lys, indicating addition of 10 mM Lys-Lys is sufficient to improve rHuPH20 stability at 40° C. Formulations with a higher pH (7.5) had reduced enzymatic activity compared to all samples with lower pH (6.5 or 7.0). For example, for samples having a pH of 6.5 or 7.0, hyaluronidase activity after 4 week incubation at 40° C. remained above 80% of the initial activity, whereas samples having a pH of 7.5 retained only about 70% of the initial activity. After 4 weeks, less than 50% of the rHuPH20 activity remained for the reference rHuPH20 sample (F1).

TABLE 81

Hyaluronidase activity at 40° C.

| | Activity (U/mL) | | | | | | Activity Ratio ($T_x/T_0$) | | | | |
|---|---|---|---|---|---|---|---|---|---|---|---|
| Form. | 0 | 1 W | 2 W | 3 W | 4 W | 8 W | 1 W | 2 W | 3 W | 4 W | 8 W |
| F1 Hylenex ™ | 169 | 127 | 105 | 84 | 73 | 43 | 0.75 | 0.62 | 0.50 | 0.43 | 0.25 |
| F2 | 149 | 141 | 141 | 133 | 132 | 114 | 0.95 | 0.95 | 0.89 | 0.89 | 0.76 |
| F3 | 146 | 123 | 128 | 110 | 113 | 84 | 0.84 | 0.87 | 0.75 | 0.77 | 0.58 |
| F4 | 152 | 148 | 152 | 143 | 139 | 118 | 0.97 | 1.00 | 0.94 | 0.91 | 0.78 |
| F5 | 159 | 151 | 148 | 141 | 140 | 107 | 0.95 | 0.93 | 0.89 | 0.88 | 0.67 |
| F6 | 148 | 133 | 130 | 114 | 111 | 82 | 0.90 | 0.87 | 0.76 | 0.75 | 0.55 |
| F7 | 156 | 130 | 129 | 110 | 101 | 87 | 0.84 | 0.83 | 0.71 | 0.95 | 0.56 |
| F8 | 156 | 141 | 144 | 137 | 132 | 107 | 0.90 | 0.92 | 0.88 | 0.85 | 0.68 |
| F9 | 155 | 140 | 136 | 134 | 127 | 109 | 0.91 | 0.88 | 0.86 | 0.82 | 0.70 |
| F10 | 153 | 146 | 141 | 137 | 135 | 112 | 0.95 | 0.92 | 0.90 | 0.88 | 0.73 |

Example 25
Effect of Lysyl Lysine on rHuPH20 Activity and Insulin Stability in rHuPH20/Insulin Co-Formulations Lysyl lysine was evaluated for its ability to stabilize co-formulations containing both rHuPH20 and an insulin analog. The formulations are set forth in Table 82 below. All formulations contained 600 U/mL rHuPH20, 3.5 mg/mL insulin glulisine, 30 mM Tris HCL, 5 mM methionine, 0.001% polysorbate 20, pH 7.2, and 0.1% phenol and 0.15% m-cresol as preservatives (EP-B preservative levels). Formulations F5, F1, F2 and F3 contained 50 mM NaCl and 0 mM, 20 mM, 40 mM and 80 mM Lys-Lys, respectively. Formulation F4 contained a higher concentration of NaCl (140 mM) and did not contain Lys-Lys. The osmolality of formulations F3 and F4 were adjusted with NaCl to be approximately the same.

Each formulation was aliquoted at 1.0 mL and filled into a 2 mL USP Type I borosilicate glass vial with 13 mm 4432/50 gray rubber stoppers and sealed with alumina seals. The vials were incubated at 5° C. and 37° C. Samples were withdrawn at days 3 and 6 and tested for hyaluronidase enzymatic activity, pH, osmolality and appearance, as described in Examples 2 and 3.

TABLE 82

Formulations containing 600 U/mL rHuPH20 and 3.5 mg/mL glulisine

| | | Buffer | Tonicity modifier | Stabilizers | | | Preservatives | |
|---|---|---|---|---|---|---|---|---|
| Form. | pH | Tris/Cl mM | NaCl mM | Methionine mM | PS20 % | Lys-Lys mM | Phenol % | m-Cresol % |
| F1 | 7.2 | 30 | 50 | 5 | 0.001 | 20 | 0.100 | 0.150 |
| F2 | 7.2 | 30 | 50 | 5 | 0.001 | 40 | 0.100 | 0.150 |

TABLE 82-continued

Formulations containing 600 U/mL rHuPH20 and 3.5 mg/mL glulisine

| Form. | pH | Buffer Tris/Cl mM | Tonicity modifier NaCl mM | Stabilizers Methionine mM | PS20 % | Lys-Lys mM | Preservatives Phenol % | m-Cresol % |
|---|---|---|---|---|---|---|---|---|
| F3 | 7.2 | 30 | 50 | 5 | 0.001 | 80 | 0.100 | 0.150 |
| F4 | 7.2 | 30 | 140 | 5 | 0.001 | 0 | 0.100 | 0.150 |
| F5 | 7.2 | 30 | 50 | 5 | 0.001 | 0 | 0.100 | 0.150 |

The addition of lysyl lysine did not affect the appearance as all formulations were clear and colorless with no visible particles indicating insulin stability. The hyaluronidase activity, as extrapolated from a standard curve, of the tested formulations is shown in Table 83 below. All formulations retained hyaluronidase activity after incubation for 6 days at 5° C. Only formula F3, which contained 80 mM Lys-Lys, retained some hyaluronidase enzymatic activity after 3 days at 37° C. After 6 days at 37° C., F3 had lost most of its hyaluronidase enzymatic activity. When osmolality was controlled to be roughly comparable, as in formulations F3 and F4, Lys-Lys was a better rHuPH20 stabilizer than NaCl, as evidenced by increased hyaluronidase activity.

TABLE 83

Hyaluronidase enzymatic activity (U/mL) and osmolality

| Form. | Osmolality (mOsm) | 5° C. 6 d | 37° C. 3 d | 37° C. 6 d |
|---|---|---|---|---|
| F1 | 238 | 556 | 13 | −18 |
| F2 | 288 | 589 | 63 | 1 |
| F3 | 396 | 563 | 165 | 79 |
| F4 | 347 | 582 | 70 | 9 |
| F5 | 182 | 541 | 5 | −4 |

Example 26

Comparison of Lysyl Lysine and NaCl on rHuPH20 Stability in rHuPH20/Insulin Co-Formulations Co-formulations of insulin and rHuPH20 were tested for the effects of lysyl lysine and NaCl on rHuPH20 stability. The tested formulations were generated to have equal ionic strength, but with one formulation containing lysyl lysine and NaCl and the other formulation containing only NaCl. Specifically, three sets of insulin glulisine and rHuPH20 formulations having different levels of ionic strength were prepared. The formulations are set forth in Table 84 below. All formulations contained 600 U/mL rHuPH20, 3.5 mg/mL insulin glulisine, 30 mM Tris HCL, 5 mM methionine, 0.001% polysorbate 20, pH 7.2, and 0.1% phenol and 0.15% m-cresol as preservatives (EP-B preservative levels). Formulations F1, F3 and F5 contained lysyl lysine and NaCl as set forth in Table 84 below. Formulations F2, F4 and F6 contained only NaCl. The formulations were tested for their actual pH and osmolality.

Each formulation was aliquotted at 1.0 mL and filled into a 2 mL USP Type I borosilicate glass vial with 13 mm 4432/50 gray rubber stoppers and sealed with alumina seals. The vials were incubated at 5° C. and 30° C. for up to 4 weeks. Samples were withdrawn on day 6 and after 2 and 4 weeks and tested for hyaluronidase enzymatic activity as described in Example 2.

TABLE 84

Formulations containing 600 U/mL rHuPH20 and 3.5 mg/mL glulisine

| Form. | pH | Buffer Tris/Cl mM | Tonicity modifier NaCl mM | Stabilizers Methionine mM | PS20 % | Lys-Lys mM | Preservatives Phenol % | m-Cresol % |
|---|---|---|---|---|---|---|---|---|
| F1 | 7.2 | 30 | 40 | 5 | 0.001 | 20 | 0.100 | 0.150 |
| F2 | 7.2 | 30 | 60 | 5 | 0.001 | None | 0.100 | 0.150 |
| F3 | 7.2 | 30 | 80 | 5 | 0.001 | 40 | 0.100 | 0.150 |
| F4 | 7.2 | 30 | 120 | 5 | 0.001 | None | 0.100 | 0.150 |
| F5 | 7.2 | 30 | 160 | 5 | 0.001 | 80 | 0.100 | 0.150 |
| F6 | 7.2 | 30 | 240 | 5 | 0.001 | None | 0.100 | 0.150 |

The results are shown in Table 85 below, which sets forth the hyaluronidase enzymatic activity (U/mL) at the tested days as well as the % hyaluronidase activity compared to the activity exhibited at T0 (% to T0). A multi-variable analysis of rHuPH20 enzymatic activity in response to incubation time, lysyl lysine concentration and ionic strength was performed based on relative activity to T0, and analyzed by JMP v. 8.02 (SAS Institutes). Formulations having higher ionic strength (F5 and F6) retained higher hyaluronidase enzymatic activity than formulations having lower ionic strength (F1 and F2) (p<0.001). Further, formulations containing lysyl lysine had significantly higher activity than those without (p=0.04). Rate of hyaluronidase enzymatic activity loss correlated with ionic strength, indicating higher ionic strength could significantly reduce the rate of degradation. For solutions at the same ionic strength (e.g., F5 and F6) no significant difference was observed after two weeks time, however after 4 weeks at 30° C., a significant difference was observed in hyaluronidase enzymatic activity, with F5 containing lysyl lysine retaining 91% activity but F6, which did not contain lysyl lysine, having only 75% activity remaining. The same trend was observed for formulations at lower ionic strength, with formulations containing lysyl lysine having increased activity as compared to those without lysyl lysine.

TABLE 85 pH, osmolality and rHuPH20 enzymatic activity at 30° C.

| Form. | pH | Osmolality (mOsm) | rHuPH20 activity, U/mL (% to T0) | | | |
|---|---|---|---|---|---|---|
| | | | T0 | 6 d | 2 w | 4 w |
| F1 | 7.17 | 204 | 567 (100%) | 505 (89%) | 405 (71%) | 288 (51%) |
| F2 | 7.22 | 210 | 523 (100%) | 416 (80%) | 334 (64%) | 222 (42%) |
| F3 | 7.23 | 321 | 543 (100%) | 517 (95%) | 481 (88%) | 400 (73%) |
| F4 | 7.20 | 312 | 528 (100%) | 471 (89%) | 438 (83%) | 332 (63%) |
| F5 | 7.22 | 542 | 525 (100%) | 522 (99%) | 496 (94%) | 476 (91%) |
| F6 | 7.19 | 531 | 511 (100%) | 533 (104%) | 498 (97%) | 382 (75%) |

Example 27

Effect of Lysyl Lysine as a Buffer and Effects of Temperature on pH Change of rHuPH20/Insulin Co-Formulations Lysyl lysine was evaluated for its ability to act as a buffer in co-formulations containing rHuPH20 and insulin by replacing Tris with lysyl lysine. The tested formulations are set forth in Table 86 below. All formulations were generated to contain 600 U/mL rHuPH20, 3.5 mg/mL insulin glulisine, 5 mM methionine, 0.001% polysorbate 20, pH 7.2, and 0.1% phenol and 0.15% m-cresol as preservatives (EP-B preservative levels). Each formulation contained 30, 50, 80 or 105 mM lysyl lysine (Biopeptide, G-2675, Lot#1037762). No formulation contained Tris HCl. NaCl was added to adjust the final osmolality to 380±30 mOsm.

Each formulation was aliquotted at 1.0 mL and filled into a 2 mL USP Type I borosilicate glass vial with 13 mm 4432/50 gray rubber stoppers and sealed with alumina seals. The vials were incubated at 5° C. and 37° C. Samples were withdrawn at days 1, 4 and 6 and tested for hyaluronidase enzymatic activity, pH and osmolality, as described in Examples 2 and 3. Each formulation also was tested to evaluate the ability of lysyl lysine to act as a buffer at the target pH range of pH 6.5 to 8.0 by generating a titration curve of the pH as a function of the amount of titrant (1N NaOH; EMD, Cat No. SX0607H-6, Lot HC067239) that was added.

TABLE 86

Formulations containing 600 U/mL rHuPH20 and 3.5 mg/mL glulisine

| Form. | pH | Tonicity modifier NaCl mM | Stabilizers | | | Preservatives | |
|---|---|---|---|---|---|---|---|
| | | | Methionine mM | PS20 % | Lys-Lys mM | Phenol % | m-Cresol % |
| F1 | 7.2 | 0 | 5 | 0.001 | 105 | 0.100 | 0.150 |
| F2 | 7.2 | 40 | 5 | 0.001 | 80 | 0.100 | 0.150 |
| F3 | 7.2 | 85 | 5 | 0.001 | 50 | 0.100 | 0.150 |
| F4 | 7.2 | 115 | 5 | 0.001 | 30 | 0.100 | 0.150 |

The results are shown in Table 87, which set forth the osmolality and hyaluronidase enzymatic activity. As shown in previous examples, Lys-Lys stabilized rHuPH20 in the formulations as hyaluronidase activity was decreased less with higher concentrations of Lys-Lys. Further, lysyl lysine was able to stabilize rHuPH20 more than NaCl at a similar level of ionic strength.

TABLE 87

Osmolality and hyaluronidase activity

| Form. | Osmolality (mOsm) | rHuPH20 activity, U/mL | | | |
|---|---|---|---|---|---|
| | | T0 | 1 d | 4 d | 6 d |
| F1 | 373 | 507 | 408 | 263 | 134 |
| F2 | 382 | 550 | 411 | 218 | 85 |
| F3 | 410 | 535 | 403 | 213 | 81 |
| F4 | 368 | 582 | 421 | 170 | 54 |

Table 88 below sets forth the pH at various temperatures and effect of temperature on the pH. Titration of lysyl lysine with NaOH revealed that lysyl lysine can serve as a buffer at a pH range of 6.5 to 8.0, especially at higher concentrations (e.g., 80 or 105 mM). As shown in Table 88, the temperature effect (dpH/dT), or ratio of the change in pH to the change in temperature, remained constant, at −0.033 U/° C., which is slightly higher than reported for Tris (−0.028 U/° C.). An ideal buffer has a larger temperature effect, as at lower storage temperatures (e.g., 2-8° C.) insulin benefits from a higher pH whereas at higher temperatures, rHuPH20 benefits from a lower pH. Thus, lysyl lysine is shown to be both an optimal buffer and a stabilizer in formulations containing both insulin and rHuPH20.

TABLE 88

Effect of temperature on the pH

| Form. | Actual pH at temperature | | | Temperature Effect dpH/dT (U/° C.) |
|---|---|---|---|---|
| | 0° C. | 22° C. | 37° C. | |
| F1 | 7.93 | 7.20 | 6.72 | −0.033 |
| F2 | 7.93 | 7.26 | 6.71 | −0.033 |
| F3 | 7.96 | 7.26 | 6.73 | −0.033 |
| F4 | 7.94 | 7.23 | 6.72 | −0.033 |

Example 28

Stability of rHuPH20 in Insulin Co-Formulations Containing Lysyl Lysine Over Time at 5° C., 30° C. and 37° C.

Lysyl lysine was tested for its ability to stabilize insulin analog-rHuPH20 co-formulations containing USP levels of preservatives. The formulations are set forth in Table 89 below. Each formulation contains 600 U/mL rHuPH20, 3.5 mg/mL insulin analog (either insulin glulisine or insulin aspart), 5 mM methionine, 0.001% surfactant (either poloxamer 188 or polysorbate 20), and USP levels of preservatives (0.125% phenol and 0.075% m-cresol). For each insulin analog, two formulations had a pH of 7.0 and two formulations had a pH of 7.2. Further, at each pH, one formulation contained only 100 mM lysyl lysine whereas the other formulation contained 30 mM NaCl and 80 mM lysyl lysine. As a comparison for insulin aspart, F9 was prepared containing 30 mM Tris/HCl.

Each formulation was aliquotted at 1.0 mL and filled into a 2 mL USP Type I borosilicate glass vial with 13 mm 4432/50 gray rubber stoppers and sealed with alumina seals. The vials were incubated at 5° C., 30° C. and 37° C. for up to 4 weeks. Samples were withdrawn as indicated in Tables 90 and 91 and tested for rHuPH20 enzymatic activity as described in Example 2. The results are shown in Tables 90 and 91 below, which set forth the hyaluronidase enzymatic activity in U/mL.

1. rHuPH20-Insulin Glulisine Co-Formulations

As shown in Table 90, for rHuPH20-insulin glulisine formulations, hyaluronidase activity remained constant for all formulations at 5° C. and 30° C. At 37° C., a decrease in hyaluronidase activity was observed over time among all formulations. Over the time period tested, the formulations were determined to be stable, since none of the formulations had hyaluronidase activity below 375 U/mL.

TABLE 90

Hyaluronidase activity (rHuPH20-glulisine formulations)

| | 5° C. | | | | 30° C. | | 37° C. | |
|---|---|---|---|---|---|---|---|---|
| Form. | T0 | 4 w | 2 M | 3 M | 2 w | 4 w | 3 d | 6 d |
| F1 | 783 | 710 | 740 | 743 | 713 | 790 | 708 | 647 |
| F2 | 811 | 770 | 776 | 745 | 741 | 834 | 726 | 678 |
| F3 | 730 | 689 | 718 | 681 | 689 | 752 | 645 | 545 |
| F4 | 688 | 655 | 718 | 646 | 665 | 676 | 581 | 491 |

2. rHuPH20-Insulin Aspart Co-Formulations

As shown in Table 91, for rHuPH20-insulin aspart formulations, all formulations were stable for up to 3 months at 5° C. At 30° C., all formulations containing lysyl lysine were stable for up to 4 weeks, whereas formulation F9 (containing no Lys-Lys) showed a loss in hyaluronidase activity. At 37° C., all formulations had decreased hyaluronidase activity over time, with the rate of decline depending on the formulation. For example, after 6 days at 37° C., formulation F5 (having 100 mM Lys-Lys and pH 7.0) had higher activity than formulation F8 (having 80 mM Lys-Lys and pH 7.2). At this time point and temperature, formulation F9 that did not contain lysyl lysine lost almost all hyaluronidase activity.

TABLE 91

Hyaluronidase activity (rHuPH20-aspart formulations)

| | 5° C. | | | | 30° C. | | 37° C. | |
|---|---|---|---|---|---|---|---|---|
| Form. | T0 | 4 w | 2 M | 3 M | 2 w | 4 w | 3 d | 6 d |
| F5 | 741 | 661 | 762 | 775 | 677 | 726 | 622 | 505 |
| F6 | 749 | 676 | 795 | 672 | 687 | 739 | 600 | 495 |
| F7 | 712 | 625 | 726 | 635 | 601 | 656 | 544 | 413 |

TABLE 89

Formulations containing 600 U/mL rHuPH20 and 3.5 mg/mL insulin analog

| Form. | Buffer | | Tonicity modifier | Stabilizers | | Surfactant | | Preservatives | | API |
|---|---|---|---|---|---|---|---|---|---|---|
| | pH | Tris/Cl mM | NaCl mM | Methionine mM | Lys-Lys mM | F68 % | PS20 % | Phenol % | m-Cresol % | Insulin Analog |
| F1 | 7.0 | 0 | 0 | 5 | 100 | | 0.001 | 0.125 | 0.075 | glulisine |
| F2 | 7.0 | 0 | 30 | 5 | 80 | | 0.001 | 0.125 | 0.075 | glulisine |
| F3 | 7.2 | 0 | 0 | 5 | 100 | | 0.001 | 0.125 | 0.075 | glulisine |
| F4 | 7.2 | 0 | 30 | 5 | 80 | | 0.001 | 0.125 | 0.075 | glulisine |
| F5 | 7.0 | 0 | 0 | 5 | 100 | 0.01 | | 0.125 | 0.075 | aspart |
| F6 | 7.0 | 0 | 30 | 5 | 80 | 0.01 | | 0.125 | 0.075 | aspart |
| F7 | 7.2 | 0 | 0 | 5 | 100 | 0.01 | | 0.125 | 0.075 | aspart |
| F8 | 7.2 | 0 | 30 | 5 | 80 | 0.01 | | 0.125 | 0.075 | aspart |
| F9 | 7.2 | 30 | 100 | 5 | 0 | 0.01 | | 0.125 | 0.075 | aspart |

*F68 = poloxamer 188 (Pluronic ® F68); PS20 = polysorbate 20.

TABLE 91-continued

Hyaluronidase activity (rHuPH20-aspart formulations)

| | 5° C. | | | 30° C. | | 37° C. | |
|---|---|---|---|---|---|---|---|
| Form. | T0 | 4 w | 2 M | 3 M | 2 w | 4 w | 3 d | 6 d |
| F8 | 703 | 608 | 729 | 621 | 605 | 638 | 499 | 292 |
| F9 | 806 | 695 | 851 | 713 | 582 | 448 | 279 | 65 |

Example 29
Effect of Human Serum Albumin (HSA) or Lysyl Lysine on Stability of rHuPH20 Under Agitation and Thermal Stress rHuPH20 formulations were tested for stability under accelerated conditions, including agitation and thermal stress. The formulations are set forth in Table 92 below. Each formulation contained 160 U/mL rHuPH20, 12.5 mM Sodium phosphate, pH 7.0 and 145 mM NaCl. Each formulation additionally contained one or more of human serum albumin (HSA), $CaCl_2$, EDTA, polysorbate 80, methionine and lysyl lysine, as set forth in Table 92 below.

Each formulation was aliquotted at 1.5 mL and filled into a 2 mL USP Type I borosilicate glass vial with 13 mm 4432/50 gray rubber stoppers and sealed with alumina seals. Vials containing visible particles were excluded from the study. The formulations were tested under both agitation and thermal stress. For the agitation study, 2 samples of each formulation were incubated at 25° C. and agitated at 650 rpm for 72 hours. For the thermal stress study, 4 samples of each formulation were incubated at 40° C. for up to 4 weeks, with samples withdrawn every week.

TABLE 92 rHuPH20 Formulations

| Form. | PH20 U/mL | Buffer, pH | NaCl mM | HSA mg/mL | $CaCl_2$ mM | EDTA % | PS80 % | Met mM | Lys-Lys mM |
|---|---|---|---|---|---|---|---|---|---|
| F1 | 160 | 12.5 mM $NaPO_4$, 7.0 | 145 | 1 | 2.7 | 0.1 | 0 | 0 | 0 |
| F2 | 160 | 12.5 mM $NaPO_4$, 7.0 | 145 | 1 | 0 | 0 | 0 | 0 | 0 |
| F3 | 160 | 12.5 mM $NaPO_4$, 7.0 | 145 | 1 | 0 | 0 | 0.02 | 0 | 0 |
| F4 | 160 | 12.5 mM $NaPO_4$, 7.0 | 145 | 0 | 0 | 0 | 0.02 | 10 | 0 |
| F5 | 160 | 12.5 mM $NaPO_4$, 7.0 | 145 | 0 | 0 | 0 | 0.04 | 10 | 0 |
| F6 | 160 | 12.5 mM $NaPO_4$, 7.0 | 145 | 0 | 0 | 0 | 0.06 | 10 | 0 |
| F7 | 160 | 12.5 mM $NaPO_4$, 7.0 | 145 | 0 | 0 | 0 | 0.02 | 10 | 10 |

All samples were tested for hyaluronidase activity as described in Example 2. The presence of insoluble and soluble particles were tested using a MicroFlow Imaging (MFI). For this, each rHuPH20 formulation or control sample was measured with a Micro-Flow Imaging instrument Model 4200 (Brightwell Technologies, Inc., Ottawa, Canada). Prior to each run, blank buffer was filtered through a 0.22 micron filter and flushed through the system to provide a clean background and optimize illumination. To equilibrate the system, at least 2 mL of sample was dispensed before analysis. One (1) ml samples were run at a flow rate of 170 μL/min using a peristaltic pump. The magnification setting was 5× to allow detection of particles within the range of 1 to 100 μm with an analysis depth field of 100 μm. Particles were counted and recorded automatically by the machine and reported as particle number/mL. Buffer and or formulations that contained rHuPH20 but were not subjected to agitation were used as controls. Size exclusion chromatography also was performed as described in Example 4. The results are shown in Tables 93-95 below.

1. Hyaluronidase Activity

Table 93 sets forth the hyaluronidase activity in U/mL and the % of activity as compared to time 0 (T0). The results show that after 8 days at 40° C., formulations that did not contain HSA (F4, F5 and F6) had reduced hyaluronidase activity compared to formulations F1, F2 and F3 that contained HSA. Formulation F7, containing Lys-Lys, retained the highest level of hyaluronidase activity after 15 days at 40° C.

After agitation stress, formulations containing at least 0.04% polysorbate 80 and 10 mM methionine retained hyaluronidase activity, as did the formulation containing Lys-Lys. Formulations F1-F4 had a slight decrease in hyaluronidase activity. Overall, formulation F7 (containing Lys-Lys) exhibited the greatest retention in rHuPH20 enzymatic activity under both the thermal stress test and agitation test.

TABLE 93

Hyaluronidase activity under agitation and thermal stress

| Form. | Time 0 | Agitation 25° C., 72 h U/mL (% t0) | 40° C., 8 days U/mL (% t0) | 40° C., 15 days U/mL (% t0) |
|---|---|---|---|---|
| F1 | 155 | 146 (94) | 149 (96) | 139 (90) |
| F2 | 154 | 144 (94) | 150 (97) | 134 (87) |
| F3 | 153 | 142 (93) | 153 (100) | 132 (86) |
| F4 | 155 | 148 (96) | 122 (79) | 100 (65) |

TABLE 93-continued

Hyaluronidase activity under agitation and thermal stress

| Form. | Time 0 | Agitation 25° C., 72 h U/mL (% t0) | 40° C., 8 days U/mL (% t0) | 40° C., 15 days U/mL (% t0) |
|---|---|---|---|---|
| F5 | 153 | 158 (103) | 110 (72) | 105 (69) |
| F6 | 153 | 157 (103) | 117 (76) | 107 (70) |
| F7 | 151 | 153 (101) | 147 (97) | 147 (97) |

2. Presence of Aggregated Protein or Insoluble Aggregates

Table 94 sets forth the particulate counts (insoluble aggregates) in particle number/mL for each micron size range. For example, micron size ranges that were tested using MFI were particles (p) greater than 5 micrometers (μm) but less than 10 μm (5≤p<10), 10≤p<25, 25≤p<50 and p≥50. Control formulations for F1 and F4 were generated that did not contain rHuPH20, and control formulations for F2, F4 and F6 samples were the same formulations that were not agitated.

The presence or absence of HSA did not affect control non-agitated samples, with each having approximately equal particle counts. Once agitated, formulations containing HSA but lacking polysorbate 80 (F1 and F2) had significantly more particles than all other formulations, including F3 that only differed from F2 by addition of polysorbate 80. Addition of more polysorbate 80 (F5 and F6 compared to F4) did not have a significant effect in reducing aggregate formation. Formulation F7, containing Lys-Lys, had the smallest numbers of insoluble aggregates after agitation.

TABLE 94

| | Particulate counts as measured by MFI (particle number/mL) | | | | | | | | | | | |
|---|---|---|---|---|---|---|---|---|---|---|---|---|
| | Agitation | | | | Control (non-agitated samples) | | | | Buffer (no rHuPH20) | | | |
| | 5 ≤ p < 10 | 10 ≤ p < 25 | 25 ≤ p < 50 | p ≥ 50 | 5 ≤ p < 10 | 10 ≤ p < 25 | 25 ≤ p < 50 | p ≥ 50 | 5 ≤ p < 10 | 10 ≤ p < 25 | 25 ≤ p < 50 | p ≥ 50 |
| 1 | 9770 | 5385 | 1090 | 248 | — | — | — | — | 403 | 58 | 7 | 0 |
| 2 | 10858 | 6930 | 795 | 139 | 1257 | 397 | 15 | 0 | — | — | — | — |
| 3 | 2895 | 382 | 39 | 10 | — | — | — | — | — | — | — | — |
| 4 | 2380 | 267 | 27 | 7 | 1356 | 167 | 0 | 3 | 31 | 8.0 | 0 | 0 |
| 5 | 2313 | 211 | 5 | 0 | — | — | — | — | — | — | — | — |
| 6 | 2610 | 432 | 41 | 8 | 1667 | 150 | 6 | 0 | — | — | — | — |
| 7 | 1299 | 129 | 5 | 0 | — | — | — | — | — | — | — | — | p—particle size (microns)

3. Size Exclusion Chromatography

Soluble aggregates were also measured by size exclusion chromatography. Table 95 sets forth the soluble aggregates (high molecular weight aggregates) in mAu*min and the percentage of total peak area. Formulations F4 to F7 contained too little protein to detect by size exclusion chromatography. Formulations F1-F3, containing HSA, showed low levels of high molecular weight aggregates after agitation at 25° C. Addition of polysorbate 80 reduced the overall number of aggregates (F3 compared to F1 or F2).

TABLE 95

| | Soluble aggregates as measured by size exclusion chromatography in mAu*min (% total peak area) | | | |
|---|---|---|---|---|
| | Control 5° C., T0 | | Agitation 72 hr @650 rpm (25° C.) | |
| Form. SEC | Main | HMW | Main | HMW |
| F1 | 4066 (97.9) | 86 (2.1) | 4020 (97.1) | 120 (2.9) |
| F2 | 4023 (98.0) | 81 (2.0) | 3913 (97.3) | 108 (2.7) |
| F3 | 3970 (98.0) | 82 (2.0) | 3950 (98.0) | 79 (2.0) |
| F4 | 20 | ND | 19 | ND |
| F5 | 21 | ND | 19 | ND |
| F6 | 22 | ND | 21 | ND |
| Fs7 | 21 | ND | 20 | ND |

HMW = high molecular weight

Since modifications will be apparent to those of skill in this art, it is intended that this invention be limited only by the scope of the appended claims.

SEQUENCE LISTING (273 sequences)

SEQ ID NO: 1 - protein, 509 aa, Homo sapiens
  precursor human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble rHuPH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  soluble rHuPH20 1-446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  soluble rHuPH20 1-445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  soluble rHuPH20 1-444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  soluble rHuPH20 1-443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  soluble rHuPH20 1-442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  hyalurinidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes bacteriophage H4489A
  hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  sHuPH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  sHuPH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  sHuPH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  sHuPH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  sHuPH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  sHuPH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  sHuPH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  sHuPH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  sHuPH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble rHuPH20 aa 431-447
DAFKLPPMETEEPQIFY

SEQ ID NO: 58 - protein, 16 aa, Homo sapiens
  C-terminal peptide cleaved from soluble rHuPH20 aa 431-446
DAFKLPPMETEEPQIF

SEQ ID NO: 59 - protein, 15 aa, Homo sapiens
  C-terminal peptide cleaved from soluble rHuPH20 aa 431-445
DAFKLPPMETEEPQI

SEQ ID NO: 60 - protein, 14 aa, Homo sapiens
  C-terminal peptide cleaved from soluble rHuPH20 aa 431-444
DAFKLPPMETEEPQ

SEQ ID NO: 61 - protein, 13 aa, Homo sapiens
  C-terminal peptide cleaved from soluble rHuPH20 aa 431-443
DAFKLPPMETEEP

SEQ ID NO: 62 - protein, 12 aa, Homo sapiens
  C-terminal peptide cleaved from soluble rHuPH20 aa 431-442
DAFKLPPMETEE

SEQ ID NO: 63 - protein, 520 aa, Ovis aries
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp. (strain FB24)
  hyaluronan lyase
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae 18RS21
  hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae serotype Ia
  hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae serotype III
  hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus (strain COL); identical to SEQ ID NO: 33
  hyaluronan lyase

SEQ ID NO: 75 - protein, 420 aa, Staphylococcus aureus (strain MRSA252)
  hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus (strain MRSA252)
  hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus (strain MSSA476)
  hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus (strain NCTC 8325); identical to SEQ ID NO: 33
  hyaluronan lyase

SEQ ID NO: 79 - protein, 809 aa, Staphylococcus aureus (strain bovine RF122)
  hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus (strain bovine RF122)
  hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus (strain USA300); identical to SEQ ID NO: 33
  hyaluronan lyase

SEQ ID NO: 82 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae (strain ATCC BAA-255/R6)
  hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae serotype 2 (strain D39/NCTC 7466)
  hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes serotype M1
  hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes serotype M2 (strain MGAS10270)
  hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes serotype M4 (strain MGAS10750)
  hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes serotype M6
  hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes serotype M12 (strain MGAS2096)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes serotype M12 (strain MGAS2096)
  hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes serotype M12 (strain MGAS9429)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes serotype M28
  hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri (strain ATCC 700601 / ES114)
  hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp. (strain RCC307)
  hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 700 aa, Pedobacter heparinus
  chondroitin AC lyase
MKKLFVTCIVFFSILSPALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 110 aa, Homo sapiens
  Preproinsulin
  SIGNAL (1)...(24): Signal sequence
  CHAIN (25)...(54): Insulin B Chain
  PROPEP (57)...(87): Insulin C peptide
  CHAIN (90)...(110): Insulin A chain
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 102 - protein, 86 aa, Homo sapiens
  Proinsulin
  CHAIN (66)...(86): Insulin B Chain
  PROPEP (33)...(63): Insulin C peptide
  CHAIN (1)...(30): Insulin A chain
FVNQHLCGSHLVEALYLVCGERGFFYTPKTRREAEDLQVGQVELGGGPGAGSLQPLALEGSLQKRGIVEQCCTSICSLYQLENYCN

SEQ ID NO: 103 - protein, 21 aa, Homo sapiens
  Insulin A chain
GIVEQCCTSICSLYQLENYCN

SEQ ID NO: 104 - protein, 30 aa, Homo sapiens
  Insulin B chain
FVNQHLCGSHLVEALYLVCGERGFFYTPKT

SEQ ID NO: 105 - protein, 110 aa, Gorilla gorilla; identical to SEQ ID NO: 101
  Preproinsulin
  CHAIN (66)...(86): Insulin B Chain
  CHAIN (1)...(30): Insulin A chain

SEQ ID NO: 106 - protein, 110 aa, Pongo pygmaeus
  Preproinsulin
MALWMRLLPLLALLALWGPDPAQAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 107 - protein, 110 aa, Pan troglodytes
  Preproinsulin
MALWMRLLPLLVLLALWGPDPASAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 108 - protein, 110 aa, Macaca fascicularis
  Preproinsulin
MALWMRLLPLLALLALWGPDPAPAFVNQHLCGSHLVEALYLVCGERGFFYTPKTRREAEDPQVGQVELGGGPGAGSLQPLALEGSLQKRGIVEQCCTSICSLYQLENYCN

SEQ ID NO: 109 - protein, 110 aa, Cercopithecus aethiops
  Preproinsulin
MALWMRLLPLLALLALWGPDPVPAFVNQHLCGSHLVEALYLVCGERGFFYTPKTRREAEDPQVGQVELGGGPGAGSLQPLALEGSLQKRGIVEQCCTSICSLYQLENYCN

SEQ ID NO: 110 - protein, 110 aa, Canis familiaris
  Preproinsulin
MALWMRLLPLLALLALWAPAPTRAFVNQHLCGSHLVEALYLVCGERGFFYTPKARREVEDLQVRDVELAGAPGEGGLQPLALEGALQKRGIVEQCCTSICSLYQLENYCN

SEQ ID NO: 111 - protein, 110 aa, Spermophilus tridecemlineatus
  Preproinsulin
MALWTRLLPLLALLALLGPDPAQAFVNQHLCGSHLVEALYLVCGERGFFYTPKSRREVEEQQGGQVELGGGPGAGLPQPLALEMALQKRGIVEQCCTSICSLYQLENYCN

SEQ ID NO: 112 - protein, 110 aa, Volemys kikuchii
  Preproinsulin
MALWMRLLPLLALLVLWEPNPAQAFVNQHLCGSHLVEALYLVCGERGFFYTPKSRRGVEDPQVAQLELGGGPGAGDLQTLALEVAQQKRGIVDQCCTSICSLYQLENYCN

SEQ ID NO: 113 - protein, 108 aa, Aotus trivirgatus
  Preproinsulin
MALWMHLLPLLALLALWGPEPAPAFVNQHLCGPHLVEALYLVCGERGFFYAPKTRREAEDLQVGQVELGGGSITGSLPPLEGPMQKRGVVDQCCTSICSLYQLQNYCN

SEQ ID NO: 114 - protein, 110 aa, Apodemus semotus
  Preproinsulin 1
MALCVRFLSLLILLILWEPNPAQAFVKQHLCGPHLVEALYLVCGERGFFYTPKSRREVEDPQVEQLELGGAPGTGDLETLALEVARQKRGIVDQCCTSICSLYQLENYCN

SEQ ID NO: 115 - protein, 110 aa, Apodemus semotus
  Preproinsulin 2
MALWMRFLPLLVLLFLWEPNPAQAFVKQHLCGSHLVEALYLVCGERGFFYTPMSRREVEDPQVAQLELGGGPGAGDLQTLALEVARQKRGIVDQCCTSICSLYQLENYCN

SEQ ID NO: 116 - protein, 110 aa, Cricetulus longicaudatus
  Preproinsulin
MTLWMRLLPLLTLLVLWEPNPAQAFVNQHLCGSHLVEALYLVCGERGFFYTPKSRRGVEDPQVAQLELGGGPGADDLQTLALEVAQQKRGIVDQCCTSICSLYQLENYCN

SEQ ID NO: 117 - protein, 110 aa, Rattus norvegicus
  Preproinsulin 1
MALWMRFLPLLALLVLWEPKPAQAFVKQHLCGPHLVEALYLVCGERGFFYTPKSRREVEDPQVPQLELGGGPEAGDLQTLALEVARQKRGIVDQCCTSICSLYQLENYCN

SEQ ID NO: 118 - protein, 110 aa, Rattus norvegicus
  Preproinsulin 2
MALWIRFLPLLALLILWEPRPAQAFVKQHLCGSHLVEALYLVCGERGFFYTPMSRREVEDPQVAQLELGGGPGAGDLQTLALEVARQKRGIVDQCCTSICSLYQLENYCN

SEQ ID NO: 119 - protein, 110 aa, Rattus losea
  Preproinsulin 1
MALWMRFLPLLALLVVWEPKPAQAFVKQHLCGPHLVEALYLVCGERGFFYTPKSRREVEDPQVPQLELGGSPEAGDLQTLALEVARQKRGIVDQCCTSICSLYQLENYCN

SEQ ID NO: 120 - protein, 110 aa, Rattus losea
  Preproinsulin 2
MALWIRFLPLLALLVLWEPRPAQAFVKQHLCGSHLVEALYLVCGERGFFYTPVSRREVEDPQVAQQELGGGPGAGDLQTLALEVARQKRGIVDQCCTSICSLYQLENYCN

SEQ ID NO: 121 - protein, 110 aa, Niviventer coxingi
  Preproinsulin 1
MALWMRFLPLLALLVLWEPNPAQAFVKQHLCGPHLVEALYLVCGERGFFYTPKSRREVEDPQVAQLELGEGPEAGDLQTLALEVARQKRGIVDQCCTSICSLYQLENYCN

SEQ ID NO: 122 - protein, 110 aa, Niviventer coxingi
  Preproinsulin 2
MALWIRFLPLLALLVLWEPHPAQAFVKQHLCGSHLVEALYLVCGERGFFYTPMSRREVEDPQVPQLELGGGPGTGDLQTLALEVARQKRGIVDQCCTSICSLYQLENYCN

SEQ ID NO: 123 - protein, 108 aa, Sus scrofa
  Preproinsulin
MALWTRLLPLLALLALWAPAPAQAFVNQHLCGSHLVEALYLVCGERGFFYTPKARREAENPQAGAVELGGGLGGLQALALEGPPQKRGIVEQCCTSICSLYQLENYCN

SEQ ID NO: 124 - protein, 110 aa, Meriones unguiculatus
  Preproinsulin
MALWMRLLPLLAFLILWEPTPAHAFVNQHLCGSHLVEALYLVCGERGFFYTPKFRRGVEDPQMPQLELGGSPGAGDLQALALEVARQKRGIVEQCCTGICSLYQLENYCN

SEQ ID NO: 125 - protein, 110 aa, Oryctolagus cuniculus
  Preproinsulin
MASLAALLPLLALLVLCRLDPAQAFVNQHLCGSHLVEALYLVCGERGFFYTPKSRREVEELQVGQAELGGGPGAGGLQPSALELALQKRGIVEQCCTSICSLYQLENYCN

SEQ ID NO: 126 - protein, 108 aa, Mus musculus
  Preproinsulin 1
MALLVHFLPLLALLALWEPKPTQAFVKQHLCGPHLVEALYLVCGERGFFYTPKSRREVEDPQVEQLELGGSPGDLQTLALEVARQKRGIVDQCCTSICSLYQLENYCN

SEQ ID NO: 127 - protein, 110 aa, Mus musculus
  Preproinsulin 2
MALWMRFLPLLALLFLWESHPTQAFVKQHLCGSHLVEALYLVCGERGFFYTPMSRREVEDPQVAQLELGGGPGAGDLQTLALEVAQQKRGIVDQCCTSICSLYQLENYCN

SEQ ID NO: 128 - protein, 110 aa, Mus spretus; identical to SEQ ID NO: 127
  Preproinsulin 2

SEQ ID NO: 129 - protein, 108 aa, Mus caroli
  Preproinsulin 1
MALLVRFLPLLALLALWEPKPTQAFVKQHLCGPHLVEALYLVCGERGFFYSPKSRREVEDPQVEQLELGGSPGDLQTLALEVAREKRGIVDQCCTSICSLYQLENYCN

SEQ ID NO: 130 - protein, 110 aa, Mus caroli
  Preproinsulin 2
MALWMRFLPLVALLFLWESHPTQAFVKQHLCGSHLVEALYLVCGERGFFYTPMSRREVEDPQVAQLELGGGPGAGDLQTLALEVAQQKRGIVDQCCTSICSLYQLENYCN

SEQ ID NO: 131 - protein, 110 aa, Psammomys obesus
  Preproinsulin
MALWMRLLPLLAFLILWEPSPAHAFVNQHLCGSHLVEALYLVCGERGFFYTPKFRRGVDDPQMPQLELGGSPGAGDLRALALEVARQKRGIVEQCCTGICSLYQLENYCN

SEQ ID NO: 132 - protein, 110 aa, Felis silvestris catus
  Preproinsulin
MAPWTRLLPLLALLSLWIPAPTRAFVNQHLCGSHLVEALYLVCGERGFFYTPKARREAEDLQGKDAELGEAPGAGGLQPSALEAPLQKRGIVEQCCASVCSLYQLEHYCN

SEQ ID NO: 133 - protein, 105 aa, Bos taurus
  Preproinsulin
MALWTRLRPLLALLALWPPPPARAFVNQHLCGSHLVEALYLVCGERGFFYTPKARREVEGPQVGALELAGGPGAGGLEGPPQKRGIVEQCCASVCSLYQLENYCN

SEQ ID NO: 134 - protein, 105 aa, Ovis aries
  Preproinsulin
MALWTRLVPLLALLALWAPAPAHAFVNQHLCGSHLVEALYLVCGERGFFYTPKARREVEGPQVGALELAGGPGAGGLEGPPQKRGIVEQCCAGVCSLYQLENYCN

SEQ ID NO: 135 - protein, 110 aa, Cavia porcellus
  Preproinsulin
MALWMHLLTVLALLALWGPNTGQAFVSRHLCGSNLVETLYSVCQDDGFFYIPKDRRELEDPQVEQTELGMGLGAGGLQPLALEMALQKRGIVDQCCTGTCTRHQLQSYCN

SEQ ID NO: 136 - protein, 86 aa, Equus caballus
  Proinsulin
  UNSURE 31: Xaa=Basic residue assumed by homology
  UNSURE 32: Xaa=Basic residue assumed by homology
  UNSURE 64: Xaa=Basic residue assumed by homology
  UNSURE 65: Xaa=Basic residue assumed by homology
FVNQHLCGSHLVEALYLVCGERGFFYTPKAXXEAEDPQVGEVELGGGPGLGGLQPLALAGPQQXXGIVEQCCTGICSLYQLENYCN

SEQ ID NO: 137 - protein, 109 aa, Octodon degus
  Preproinsulin
MAPWMHLLTVLALLALWGPNSVQAYSSQHLCGSNLVEALYMTCGRSGFYRPHDRRELEDLQVEQAELGLEAGGLQPSALEMILQKRGIVDQCCNNICTFNQLQNYCNVP

SEQ ID NO: 138 - protein, 86 aa, Chinchilla brevicaudata
  Proinsulin
  UNSURE 31: Xaa=Basic residue assumed by homology
  UNSURE 32: Xaa=Basic residue assumed by homology
  UNSURE 64: Xaa=Basic residue assumed by homology
  UNSURE 65: Xaa=Basic residue assumed by homology
FVNKHLCGSHLVDALYLVCGDRGFFYTPMAXXELEDPQVGQADPGVVPEAGRLQPLALEMTLQXXGIVDQCCTSICTLYQLENYCN

SEQ ID NO: 139 - protein, 107 aa, Gallus gallus
  Preproinsulin
MALWIRSLPLLALLVFSGPGTSYAAANQHLCGSHLVEALYLVCGERGFFYSPKARRDVEQPLVSSPLRGEAGVLPFQQEEYEKVKRGIVEQCCHNTCSLYQLENYCN

SEQ ID NO: 140 - protein, 103 aa, Selasphorus rufus
  Proinsulin
IQSLPLLALLALSGPGTSHAAVNQHLCGSHLVEALYLVCGERGFFYSPKARRDAEHPLVNGPLHGEVGDLPFQQEEFEKVKRGIVEQCCHNTCSLYQLENYCN

SEQ ID NO: 141 - protein, 106 aa, Xenopus laevis
  Preproinsulin 1
MALWMQCLPLVLVLFFSTPNTEALVNQHLCGSHLVEALYLVCGDRGFFYYPKVKRDMEQALVSGPQDNELDGMQLQPQEYQKMKRGIVEQCCHSTCSLFQLESYCN

SEQ ID NO: 142 - protein, 106 aa, Xenopus laevis
  Preproinsulin 2
MALWMQCLPLVLVLLFSTPNTEALANQHLCGSHLVEALYLVCGDRGFFYYPKIKRDIEQAQVNGPQDNELDGMQFQPQEYQKMKRGIVEQCCHSTCSLFQLENYCN

SEQ ID NO: 143 - protein, 106 aa, Xenopus tropicalis
  Preproinsulin
MALWMQCLPLVLVLLFSTPNTEALANQHLCGSHLVEALYLVCGDRGFFYYPKIKRDIEQAMVNGPQDNELDGMQLQPQEYQKMKRGIVEQCCHSTCSLFQLESYCN

SEQ ID NO: 144 - protein, 106 aa, Rana pipiens
  Preproinsulin
MALWIQCLHIAVLLSLFTPTLKTFDNQYLCGSHLVEALYMVCGDRGFFYSPRSRRDLEQPLVNGLQGSELDEMQVQSQAFQKRKPGIVEQCCHNTCSLYDLENYCN

SEQ ID NO: 145 - protein, 81 aa, Anas platyrhynchos
  Preproinsulin
  UNSURE 31: Xaa=Basic residue assumed by homology
  UNSURE 32: Xaa=Basic residue assumed by homology
  UNSURE 59: Xaa=Basic residue assumed by homology
  UNSURE 60: Xaa=Basic residue assumed by homology
AANQHLCGSHLVEALYLVCGERGFFYSPKTXXDVEQPLVNGPLHGEVGELPFQHEEYQXXGIVEQCCENPCSLYQLENYCN

SEQ ID NO: 146 - protein, 51 aa, Capra hircus
  Preproinsulin
FVNQHLCGSHLVEALYLVCGERGFFYTPKAGIVEQCCAGVCSLYQLENYCN

SEQ ID NO: 147 - protein, 30 aa, Homo sapiens
  Aspart insulin
  Insulin B chain analog
FVNQHLCGSHLVEALYLVCGERGFFYTDKT

SEQ ID NO: 148 - protein, 30 aa, Homo sapiens
  Lispro insulin
  Insulin B chain analog
FVNQHLCGSHLVEALYLVCGERGFFYTKPT

SEQ ID NO: 149 - protein, 30 aa, Homo sapiens
  Glulisine insulin
  Insulin B chain analog
FVKQHLCGSHLVEALYLVCGERGFFYTPET

SEQ ID NO: 150 - protein, 21 aa, Homo sapiens
  Glargine insulin
  Insulin A chain analog
GIVEQCCTSICSLYQLENYCG

SEQ ID NO: 151 - protein, 32 aa, Homo sapiens
  Glargine insulin
  Insulin B chain analog
FVNQHLCGSHLVEALYLVCGERGFFYTPKTRR

SEQ ID NO: 152 - protein, 53 aa, Homo sapiens
  Detemir insulin
  Proinsulin analog
  CHAIN (33)...(53): A Chain
  CHAIN (1)...(29): B chain
FVNQHLCGSHLVEALYLVCGERGFFYTPKAAKGIVEQCCTSICSLYQLENYCN

SEQ ID NO: 153 - protein, 30 aa, Homo sapiens
  Insulin B chain analog
  VARIANT 28: Xaa=Pro, Lys, Leu, Val or Ala
  VARIANT 29: Xaa=Lys or Pro
FVNQHLCGSHLVEALYLVCGERGFFYTXXT

SEQ ID NO: 154 - protein, 27 aa, Homo sapiens
  Insulin B chain analog (des 28-30)
FVNQHLCGSHLVEALYLVCGERGFFYT

SEQ ID NO: 155 - protein, 29 aa, Homo sapiens
  Insulin B chain analog (des 27)
FVNQHLCGSHLVEALYLVCGERGFFYPKT

SEQ ID NO: 156 - protein, 21 aa, Homo sapiens
  Insulin A chain analog
  VARIANT 21: Xaa=Ala, Asn, Asp, Gln, Glu, Gly, Thr or Ser
GIVEQCCTSICSLYQLENYCX

SEQ ID NO: 157 - protein, 32 aa, Homo sapiens
  Insulin B chain analog
  VARIANT 1: Xaa=Phe, Asp or none
  VARIANT 2: Xaa=Val or none
  VARIANT 3: Xaa=Asn or Asp
  VARIANT 9: Xaa=Ser or Asp
  VARIANT 10: Xaa=His or Asp
  VARIANT 28: Xaa=any amino acid
  VARIANT 29: Xaa=L-Pro, D-Pro, D-hydroxypro, L-hydroxypro, L-(N-methyllysine), D-Lysine, L-(N-methyl arginine) or D-arginine
  VARIANT 30: Xaa=Ala or Thr
  VARIANT 31: Xaa=Arg, Lys, or none
  VARIANT 32: Xaa=Arg, Lys, or none
XXXQHLCGXXLVEALYLVCGERGFFYTXXXXX

SEQ ID NO: 158 - protein, 21 aa, Homo sapiens
  Insulin A chain analog
  VARIANT 8: Xaa=His, Phe, Gly,  Gln, Glu, Ser, Asn, Asp, or Pro
  VARIANT 9: Xaa=Gly, Asp, Glu, Thr, His, Gln, Asn, Ala or Pro
  VARIANT 10: Xaa=Leu, Pro, Val, His, Ala, Glu, Asp, Thr, Gln or Asn
  VARIANT 13: Xaa=Pro, Val, Arg, His, Ala, Glu, Asp, Thr, Gly, Gln or Asn
  VARIANT 21: Xaa=Asp or Glu
GIVEQCCXXXCSXYQLENYCX

SEQ ID NO: 159 - protein, 30 aa, Homo sapiens
  Insulin B chain analog
  VARIANT 1: Xaa=Phe, Glu, Asp, Thr or Ser
  VARIANT 2: Xaa=Val, Arg, His, Ala, Glu, Asp, Thr, Pro, Gly, Gln, Ser or Asn
  VARIANT 5: Xaa=His, Ala, Glu, Asp, Thr, Ser, Gln, or Asn
  VARIANT 9: Xaa=Ser, Leu, Asp, Pro, Glu, Ile, Val, His, Thr, Gln, Asn, Met, Tyr, Trp or Phe
  VARIANT 10: Xaa=His, Asn, Leu, Asp, Arg, Glu, Ser, Thr, Ile or Gln
  VARIANT 12: Xaa=Val, Asn, His, Ile or Tyr
  VARIANT 14: Xaa=Ala, Glu,  Asp, Asn, Gln, Ser, Thr, Gly
  VARIANT 16: Xaa=Tyr, Asp, Glu, Gln, Asn, Ser, Thr, His or Arg
  VARIANT 17: Xaa=Leu, Ser, Thr, Asn, Gln, Glu, Asp or His
  VARIANT 18: Xaa=Val, Ser, Thr, Asn, Gln or His
  VARIANT 20: Xaa=Gly, Gln, Ser, Thr, Asn, Asp, Glu, His or Arg
  VARIANT 26: Xaa=Tyr, Ala, Asp, His or Glu
  VARIANT 27: Xaa=Thr, Asp, His or Glu
  VARIANT 28: Xaa=Pro, Asp or Glu
XXNQXLCGXXLXEXLXXXCXERGFFXXXKT

SEQ ID NO: 160 - protein, 21 aa, Homo sapiens
  Insulin A chain analog
  VARIANT 21: Xaa=Asn, Gly, Ala, Val, Leu, Ile, Pro, Phe, Trp, Met, Ser, Thr, Cys, Tyr, Asp or Glu
GIVEQCCTSICSLYQLENYCX

SEQ ID NO: 161 - protein, 30 aa, Homo sapiens
  Insulin B chain analog
  VARIANT 1: Xaa=Phe or none
  VARIANT 29: Xaa=Lys, Ala, Thr or Ser
  VARIANT 30: Xaa=Thr, Arg, Lys, Hyl, Orn or Cit
XVNQHLCGSHLVEALYLVCGERGFFYTPXX

SEQ ID NO: 162 - protein, 21 aa, Homo sapiens
  Insulin A chain analog
  VARIANT 21: Xaa=Asn, Gly, Ala, Val, Leu, Ile, Pro, Phe, Trp, Met, Ser, Thr, Cys, Tyr, Asp, Glu, His or Gln
GIVEQCCTSICSLYQLENYCX

SEQ ID NO: 163 - protein, 30 aa, Homo sapiens
  Insulin B chain analog
  VARIANT 1: Xaa=Phe or none
  VARIANT 3: Xaa=Asn, Gly, Ala, Val, Leu, Ile, Pro, Phe, Trp, Met, Ser, Thr, Cys, Tyr, Asp, Glu, His or Gln
  VARIANT 30: Xaa=Asn, Gly, Ala, Val, Leu, Ile, Pro, Phe, Trp, Met, Ser, Thr, Cys, Tyr, Asp, Glu, His or Gln
XVXQHLCGSHLVEALYLVCGERGFFYTPKX

SEQ ID NO: 164 - protein, 21 aa, Homo sapiens
  Insulin A chain analog
  VARIANT 8: Xaa=Ala or Thr
  VARIANT 10: Xaa=Val or Ile
  VARIANT 21: Xaa=Asn, Asp, Gly, Ser, Thr or Ala
GIVEQCCXSXCSLYQLENYCX

SEQ ID NO: 165 - protein, 30 aa, Homo sapiens
  Insulin B chain analog
  VARIANT 1: Xaa=Phe or none
  VARIANT 30: Xaa=Thr or none
XVNQHLCGSHLVEALYLVCGERGFFYTPKX

SEQ ID NO: 166 - protein, 6 aa, Artificial Sequence
  Linker Peptide Sequence
RPPPPC

SEQ ID NO: 167 - protein, 7 aa, Artificial Sequence
  Linker Peptide Sequence
SSPPPPC

SEQ ID NO: 168 - protein, 5 aa, Artificial Sequence
  Linker Peptide Sequence
GGGGS

SEQ ID NO: 169 - protein, 5 aa, Artificial Sequence
  Linker Peptide Sequence
  REPEAT (1)...(5): Repeating linker peptide
GGGGS

SEQ ID NO: 170 - protein, 12 aa, Artificial Sequence
  Linker Peptide Sequence
GKSSGSGSESKS

SEQ ID NO: 171 - protein, 14 aa, Artificial Sequence
  Linker Peptide Sequence
GSTSGSGKSSEGKG

SEQ ID NO: 172 - protein, 18 aa, Artificial Sequence
  Linker Peptide Sequence
GSTSGSGKSSEGSGSTKG

SEQ ID NO: 173 - protein, 14 aa, Artificial Sequence
  Linker Peptide Sequence
GSTSGSGKSSEGKG

SEQ ID NO: 174 - protein, 18 aa, Artificial Sequence
  Linker Peptide Sequence
GSTSGSGKPGSGEGSTKG

SEQ ID NO: 175 - protein, 14 aa, Artificial Sequence
  Linker Peptide Sequence
EGKSSGSGSESKEF

SEQ ID NO: 176 - protein, 5 aa, Artificial Sequence
  Linker Peptide Sequence
SRSSG

SEQ ID NO: 177 - protein, 5 aa, Artificial Sequence
  Linker Peptide Sequence
SGSSC

SEQ ID NO: 178 - protein, 3 aa, Artificial Sequence
  Linker Peptide Sequence
AAK

SEQ ID NO: 179 - protein, 2 aa, Artificial Sequence
  Linker Peptide Sequence
VM

SEQ ID NO: 180 - protein, 2 aa, Artificial Sequence
  Linker Peptide Sequence
AM

SEQ ID NO: 181 - protein, 59 aa, Artificial Sequence
  Linker Peptide Sequence: Ala-Met-[Gly-(Gly(n))-Gly-Ser](m)-Ala-Met, where n=1-3 and m=1-11
  REPEAT (3)...(7): occurring 1, 2, 3, 4, 5, 6, 7, 8, 9, 10 or 11 times
  VARIANT 5, 6, 10, 11, 15, 16, 20, 21, 25, 26, 30, 31, 35, 36, 40,41, 45, 46, 50, 51, 55, 56: these amino acids can be present or absent
  VARIANT (8)...(57): these amino acids can be present or absent as instances of the repeat unit described at positions 3 to 7
AMGGGGSGGGGSGGGGSGGGGSGGGGSGGGGSGGGGSGGGGSGGGGSGGGGSGGGGSAM

SEQ ID NO: 182 - protein, 30 aa, Homo sapiens
  HMR-1 153 B-chain
FVKQHLCGSHLVEALYLVCGERGFFYTIKT

SEQ ID NO: 183 - protein, 21 aa, Homo sapiens
  HMR-1 1423 A-chain
GIVEQCCTSICSLYQLENYCG

SEQ ID NO: 184 - protein, 32 aa, Homo sapiens
  HMR-1 1423 B-chain
FVNQHLCGSHLVEALYLVCGERGFFYTPKTHH

SEQ ID NO: 185 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 186 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 187 - protein, 505 aa, Homo sapiens
  HuPH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 188 - protein, 503 aa, Homo sapiens
  HuPH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 189 - protein, 501 aa, Homo sapiens
  HuPH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 190 - protein, 499 aa, Homo sapiens
  HuPH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 191 - protein, 497 aa, Homo sapiens
  HuPH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 192 - protein, 495 aa, Homo sapiens
  HuPH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 193 - protein, 493 aa, Homo sapiens
  HuPH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 194 - protein, 491 aa, Homo sapiens
  HuPH20 precursor 1-491
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 195 - protein, 489 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 196 - protein, 490 aa, Homo sapiens
  HuPH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 197 - protein, 487 aa, Homo sapiens
  HuPH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 198 - protein, 485 aa, Homo sapiens
  HuPH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 199 - protein, 484 aa, Homo sapiens
  HuPH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 200 - protein, 476 aa, Homo sapiens
  HuPH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 201 - protein, 475 aa, Homo sapiens
  HuPH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 202 - protein, 474 aa, Homo sapiens
  HuPH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 203 - protein, 473 aa, Homo sapiens
  HuPH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 204 - protein, 472 aa, Homo sapiens
  HuPH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 205 - protein, 471 aa, Homo sapiens
  HuPH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 206 - protein, 470 aa, Homo sapiens
  HuPH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 207 - protein, 469 aa, Homo sapiens
  HuPH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 208 - protein, 468 aa, Homo sapiens
  HuPH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 209 - protein, 466 aa, Homo sapiens
  HuPH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 210 - protein, 465 aa, Homo sapiens
  HuPH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 211 - protein, 464 aa, Homo sapiens
  HuPH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 212 - protein, 462 aa, Homo sapiens
  HuPH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 213 - protein, 460 aa, Homo sapiens
  HuPH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 214 - protein, 458 aa, Homo sapiens
  HuPH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 215 - protein, 456 aa, Homo sapiens
  HuPH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 216 - protein, 454 aa, Homo sapiens
  HuPH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 217 - protein, 452 aa, Homo sapiens
  HuPH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 218 - protein, 450 aa, Homo sapiens
  HuPH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 219 - protein, 508 aa, Homo sapiens
  HuPH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 220 - protein, 506 aa, Homo sapiens
  HuPH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 221 - protein, 504 aa, Homo sapiens
  HuPH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 222 - protein, 502 aa, Homo sapiens
  HuPH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 223 - protein, 500 aa, Homo sapiens
  HuPH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 224 - protein, 498 aa, Homo sapiens
  HuPH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 225 - protein, 496 aa, Homo sapiens
  HuPH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 226 - protein, 494 aa, Homo sapiens
  HuPH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 227 - protein, 492 aa, Homo sapiens
  HuPH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 228 - protein, 488 aa, Homo sapiens
  HuPH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 229 - protein, 486 aa, Homo sapiens
  HuPH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 230 - protein, 472 aa, Homo sapiens
  mature HuPH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 231 - protein, 470 aa, Homo sapiens
  mature HuPH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 232 - protein, 468 aa, Homo sapiens
  mature HuPH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 233 - protein, 466 aa, Homo sapiens
  mature HuPH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 234 - protein, 464 aa, Homo sapiens
  mature HuPH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 235 - protein, 462 aa, Homo sapiens
  esHuPH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 236 - protein, 460 aa, Homo sapiens
  esHuPH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 237 - protein, 458 aa, Homo sapiens
  esHuPH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 238 - protein, 456 aa, Homo sapiens
  esHuPH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 239 - protein, 454 aa, Homo sapiens
  mature HuPH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 240 - protein, 455 aa, Homo sapiens
  mature HuPH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 241 - protein, 452 aa, Homo sapiens
  mature HuPH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 242 - protein, 450 aa, Homo sapiens
  Mature HuPH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 243 - protein, 449 aa, Homo sapiens
  Mature HuPH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 244 - protein, 441 aa, Homo sapiens
  Mature HuPH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 245 - protein, 440 aa, Homo sapiens
  Mature HuPH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 246 - protein, 439 aa, Homo sapiens
  Mature HuPH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 247 - protein, 438 aa, Homo sapiens
  Mature HuPH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 248 - protein, 437 aa, Homo sapiens
  Mature HuPH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 249 - protein, 436 aa, Homo sapiens
  Mature HuPH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 250 - protein, 435 aa, Homo sapiens
  Mature HuPH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 251 - protein, 434 aa, Homo sapiens
  Mature HuPH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 252 - protein, 433 aa, Homo sapiens
  Mature HuPH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 253 - protein, 431 aa, Homo sapiens
  Mature HuPH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 254 - protein, 430 aa, Homo sapiens
  Mature HuPH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 255 - protein, 429 aa, Homo sapiens
  Mature HuPH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 256 - protein, 427 aa, Homo sapiens
  Mature HuPH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 257 - protein, 425 aa, Homo sapiens
  Mature HuPH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 258 - protein, 423 aa, Homo sapiens
  Mature HuPH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 259 - protein, 421 aa, Homo sapiens
  Mature HuPH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 260 - protein, 419 aa, Homo sapiens
  Mature HuPH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 261 - protein, 417 aa, Homo sapiens
  Mature HuPH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 262 - protein, 415 aa, Homo sapiens
  Mature HuPH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 263 - protein, 473 aa, Homo sapiens
  Mature HuPH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 264 - protein, 471 aa, Homo sapiens
  Mature HuPH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 265 - protein, 469 aa, Homo sapiens
  Mature HuPH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 266 - protein, 467 aa, Homo sapiens
  Mature HuPH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 267 - protein, 465 aa, Homo sapiens
  Mature HuPH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 268 - protein, 463 aa, Homo sapiens
  Mature HuPH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 269 - protein, 461 aa, Homo sapiens
  esHuPH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 270 - protein, 459 aa, Homo sapiens
  esHuPH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 271 - protein, 457 aa, Homo sapiens
  esHuPH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 272 - protein, 453 aa, Homo sapiens
  Mature HuPH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 273 - protein, 451 aa, Homo sapiens
  Mature HuPH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

What is claimed:

1. A composition, comprising:
   a therapeutically effective amount of a soluble PH20 polypeptide, wherein the soluble PH20 polypeptide is active at neutral pH; and
   lysyl lysine (Lys-Lys) at a concentration that is about 10 mM to about 200 mM, inclusive, whereby the soluble PH20 polypeptide in the composition, when incubated at a temperature of 37° C. to 42° C., inclusive, exhibits greater hyaluronidase activity than a composition that is identical, except that the composition does not contain the Lys-Lys.

2. The composition of claim 1, wherein the concentration of soluble PH20 polypeptide is at least 10 U/mL.

3. The composition of claim 1, wherein the Lys-Lys concentration is 50 mM to 150 mM, inclusive.

4. The composition of claim 1, wherein the amount of a soluble PH20 polypeptide is between 10 U/mL to 5000 U/mL, inclusive.

5. The composition of claim 1, wherein the pH of the composition is between about 6.5 to 8.0, inclusive.

6. The composition of claim 1, comprising a stabilizing agent, an antioxidant, a tonicity modifier to maintain the osmolality at between about 245 mOsm/kg to 500 mOsm/kg, inclusive, or a buffering agent.

7. The composition of claim 6, wherein the composition comprises a stabilizing agent and the stabilizing agent is selected from among an amino acid, an amino acid derivative, an amine, a sugar, a polyol, a salt and a surfactant.

8. The composition of claim 5, that includes a stabilizing agent selected from among an amino acid, an amino acid derivative, an amine, a sugar, a polyol, a salt and a surfactant.

9. The composition of claim 7, wherein the stabilizing agent is a surfactant and the amount of surfactant, as a % of mass concentration (w/v) in the formulation, is between 0.0005% to 1.0%, inclusive.

10. The composition of claim 9, wherein the surfactant is selected from among a polypropylene glycol, polyethylene glycol, glycerin, sorbitol, poloxamer and polysorbate.

11. The composition of claim 6, wherein the composition comprises an antioxidant.

12. The composition of claim 11, wherein the antioxidant is selected from among cysteine, tryptophan and methionine.

13. The composition of claim 12, wherein the antioxidant is methionine.

14. The composition of claim 11, wherein the antioxidant is at a concentration from between 5 mM to 50 mM, inclusive.

15. The composition of claim 3, comprising a tonicity modifier to maintain the osmolality of between 245 mOsm/kg to 500 mOsm/kg, inclusive.

16. The composition of claim 6, wherein the composition comprises a tonicity modifier and the tonicity modifier is selected from among glycerin, salt, amino acids, polyalcohols and trehalose.

17. The composition of claim 15, wherein the tonicity modifier is NaCl, wherein the concentration of NaCl is between about 20 mM to 200 mM, inclusive.

18. The composition of claim 16, wherein the tonicity modifier is NaCl at a concentration between about 20 mM to 200 mM, inclusive.

19. The composition of claim 18, wherein the concentration of NaCl is less than 150 mM.

20. The composition of claim 6, wherein the composition comprises a buffering agent and the buffering agent is selected from among Tris, histidine, phosphate and citrate.

21. The composition of claim 20, wherein the buffering agent is a phosphate that is sodium phosphate.

22. The composition claim 20, wherein the concentration of the buffering agent is between 1 mM to 100 mM, inclusive.

23. The composition of claim 1, wherein the soluble PH20 polypeptide is selected from ovine PH20, bovine PH20 and a soluble human PH20, wherein the soluble human PH20 lacks all or a portion of the glycosylphosphatidylinositol (GPI) anchor attachment sequence.

24. The composition of claim 23, wherein the soluble PH20 polypeptide is a soluble human PH20 that consists of the sequence of amino acids set forth in any of SEQ ID NOS: 4-9, 47-48, 234-246, 248-254, and 267-273, or a sequence of amino acids that exhibits at least 95% sequence identity to any of SEQ ID NOS: 4-9, 47-48, 234-246, 248-254, and 267-273.

25. The composition of claim 23, wherein the soluble PH20 polypeptide is a soluble human PH20 that consists of the sequence of amino acids set forth in any of SEQ ID NOS: 4-9.

26. The composition of claim 1, wherein the concentration of Lys-Lys is 10 mM to 100 mM, inclusive.

27. The composition of claim 1, wherein:
   the pH of the composition is between 6.5 to 7.2, inclusive; and the composition comprises:
   a soluble PH20 polypeptide at a concentration that is between about 100 U/mL to 500 U/mL, inclusive;
   NaCl at a concentration less than 140 mM NaCl;
   a surfactant that is polysorbate 80 at a percentage (%) of mass concentration (w/v) of between 0.01% to 0.05%, inclusive;
   methionine at a concentration that is between 5 mM to 20 mM, inclusive; and
   sodium phosphate at a concentration that is between 5 mM to 50 mM, inclusive.

28. The composition of claim 27, wherein the soluble PH20 polypeptide is selected from among ovine PH20, bovine PH20 and a soluble human PH20, wherein the soluble human PH20 lacks all or a portion of the glycosylphosphatidylinositol (GPI) anchor attachment sequence.

29. The composition of claim 1, wherein the soluble PH20 polypeptide in the composition, when incubated at a temperature of 38° C. to 42° C., exhibits at least 50% more hyaluronidase activity than a composition that is identical, except that the composition does not contain the Lys-Lys.

30. The composition of claim 1, further comprising a fast-acting insulin.

31. The composition of claim 30, wherein the concentration of Lys-Lys is 30 mM to 120 mM, inclusive.

32. The composition of claim 30, wherein the fast-acting insulin is a fast-acting insulin analog.

33. The composition of claim 32, wherein the insulin analog is selected from among insulin aspart, insulin lispro and insulin glulisine.

34. The composition of claim 33, wherein the soluble PH20 polypeptide is selected from among ovine PH20, bovine PH20 and a soluble human PH20, wherein the soluble human PH20 lacks all or a portion of the glycosylphosphatidylinositol (GPI) anchor attachment sequence.

35. The composition of claim 30, wherein the concentration of fast-acting insulin is between 10 U/mL to 1000 U/mL, inclusive.

36. The composition of claim 30, wherein:
   the fast-acting insulin is an insulin analog that is glulisine and the concentration of Lys-Lys is 50 to 105 mM; or
   the fast-acting insulin is an insulin analog that is insulin aspart or insulin lispro and the concentration of Lys-Lys is 80 to 100 mM.

37. The composition of claim 30 that is formulated as a single dosage or as a multiple dosage for direct administration, wherein if the composition is for multiple dosage administration, the composition comprises an anti-microbially effective amount of a preservative or mixture of preservatives.

38. The composition of claim 37, wherein:
the composition is formulated for multiple dosage administration; and
the preservative(s) in the formulation comprises one or more of a phenolic preservative(s), a non-phenolic preservative(s) or a phenolic preservative(s) and a non-phenolic preservative(s).

39. The composition of claim 38, wherein the preservative(s) is(are) selected from among phenol, m-cresol, methylparaben, benzyl alcohol, thimerosal, benzalkonium chloride, 4-chloro-1-butanol, chlorhexidine dihydrochloride, chlorhexidine digluconate, L-phenylalanine, EDTA, bronopol, phenylmercuric acetate, glycerol, imidurea, chlorhexidine, sodium dehydroacetate, o-cresol, p-cresol, chlorocresol, cetrimide, benzethonium chloride, ethylparaben, propylparaben, butylparaben and any combinations thereof.

40. The composition of claim 39, wherein the preservative(s) is(are) phenol, m-cresol or phenol and m-cresol.

41. The composition of claim 40, wherein the preservatives are phenol and m-cresol and the amount as a % of mass concentration (w/v) in the formulation is between 0.1% to 0.25% phenol and between 0.05% to 0.2% m-cresol, inclusive.

42. The composition of claim 38, wherein the total amount of the one or more preservative agents as a percentage (%) of mass concentration (w/v) in the formulation is or is between 0.1% and 0.4%, inclusive.

43. The composition of claim 30, wherein:
the pH of the composition is between 6.8 to 7.4, inclusive; and
the composition comprises:
a soluble PH20 polypeptide in an amount between 100 U/mL to 1000 U/mL, inclusive;
a fast-acting insulin analog that is insulin glulisine is an amount between 10 U/mL to 1000 U/mL, inclusive;
Lys-Lys at a concentration between 50 mM to 105 mM, inclusive;
NaCl at a concentration of less than 100 mM;
a surfactant that is polysorbate 20 at a percentage (%) of mass concentration (w/v) of between 0.0005% to 0.005%, inclusive;
methionine at a concentration between 5 mM to 20 mM, inclusive; and
a preservative(s) that comprises phenol at a percentage (%) of mass concentration (w/v) of between 0.1% to 0.25% and m-cresol at a % w/v of between 0.05% to 0.2%, each inclusive.

44. The composition of claim 30, wherein:
the pH of the composition is between 6.8 to 7.4, inclusive; and
the composition comprises:
a soluble PH20 polypeptide in an amount between 100 U/mL to 1000 U/mL, inclusive;
a fast-acting insulin analog that is insulin aspart or insulin lispro is an amount between 10 U/mL to 1000 U/mL, inclusive;
Lys-Lys at a concentration between 80 mM to 100 mM, inclusive;
NaCl at a concentration of less than 30 mM;
a surfactant that is polysorbate 20 at a percentage (%) of mass concentration (w/v) of between 0.0005% to 0.005%, inclusive;
methionine at a concentration between 5 mM to 20 mM, inclusive; and
a preservative(s) that comprises phenol at a percentage (%) of mass concentration (w/v) of between 0.1% to 0.25% and m-cresol at a % w/v of 0.05% to 0.2%, each inclusive.

45. A syringe or vial, comprising the composition of claim 1.

46. A syringe or vial, comprising the composition of claim 30.

47. A closed loop system, comprising the composition of claim 37.

48. An insulin pump, comprising the composition of claim 37.

49. An insulin pen, comprising the composition of claim 30.

50. A composition, comprising:
a soluble PH20 polypeptide at a concentration of between 10 U/mL to 5000 U/mL, inclusive, wherein the soluble PH20 polypeptide is active at neutral pH;
lysyl lysine (Lys-Lys) at a concentration of about 10 mM to 200 mM, inclusive, wherein the pH of the composition is between about 6.5 to 8.0, inclusive.

51. The composition of claim 50, comprising NaCl at a concentration between about 20 mM to 200 mM, inclusive.

52. The composition of claim 51, comprising lysyl lysine (Lys-Lys) at a concentration of about 50 mM to 150 mM, inclusive.

53. The composition of claim 50, wherein the soluble PH20 polypeptide is a soluble human PH20 that consists of the sequence of amino acids set forth in any of SEQ ID NOS: 4-9, 47-48, 234-246, 248-254, and 267-273, or a sequence of amino acids that exhibits at least 95% sequence identity to any of SEQ ID NOS: 4-9, 47-48, 234-246, 248-254, and 267-273.

54. The composition of claim 50, further comprising a fast-acting insulin.

55. A method of reducing a symptom of diabetes in a subject in need thereof, comprising administering to the subject a therapeutically effective amount of the composition of claim 30.

* * * * *

UNITED STATES PATENT AND TRADEMARK OFFICE
CERTIFICATE OF CORRECTION

PATENT NO. : 9,993,529 B2  
APPLICATION NO. : 13/507262  
DATED : June 12, 2018  
INVENTOR(S) : Yang et al.

Page 1 of 2

It is certified that error appears in the above-identified patent and that said Letters Patent is hereby corrected as shown below:

On the Title Page

In Item (56) References Cited, in the list of OTHER PUBLICATIONS at page 3, Column 2, Line 8, please replace "Trotein" with —protein—.

In Item (56) References Cited, in the list of OTHER PUBLICATIONS at page 4, Column 1, Line 32, please replace "asTi" with —a Ti—.

In Item (56) References Cited, in the list of OTHER PUBLICATIONS at page 5, Column 1, Line 21, please replace "Nery" with —Nerv—.

In Item (56) References Cited, in the list of OTHER PUBLICATIONS at page 6, Column 2, Line 40, please replace "12/355,657" with —12/455,657—.

In the Specification

At Column 1, Line 32, please replace "PCT/UJS2012/042818" with —PCT/US2012/042818—;

At Column 27, Line 46, please replace "PI-120" with —PH20—;

At Column 55, Line 11, please replace "ESI 14" with —ES114—;

At Column 58, Line 26, please replace "PI-120" with —PH20—; and

At Column 131, Line 31, please replace "Stem" with —Stern—.

Signed and Sealed this  
Fourth Day of December, 2018

Andrei Iancu  
*Director of the United States Patent and Trademark Office*

CERTIFICATE OF CORRECTION (continued)
U.S. Pat. No. 9,993,529 B2

In the Claims

At Column 229, Line 2 to Line 12, please replace with:
—1. A composition, comprising:
    a therapeutically effective amount of a soluble PH20 polypeptide, wherein the soluble PH20 polypeptide is active at neutral pH; and
    lysyl lysine (Lys-Lys) at a concentration that is 10 mM to 200 mM, inclusive, whereby the soluble PH20 polypeptide in the composition, when incubated at a temperature of 37° C to 42° C, inclusive, exhibits greater hyaluronidase activity than a composition that is identical, except that the composition does not contain the Lys-Lys.—;

At Column 230, Line 1 to Line 3, please replace with:
—22. The composition of claim 20, wherein the concentration of the buffering agent is between 1 mM to 100 mM, inclusive.—;

At Column 230, Line 40 to Line 44, please replace with:
—29. The composition of claim 1, wherein the soluble PH20 polypeptide in the
    composition, when incubated at a temperature of 38° C to 42° C, exhibits at least 50% more hyaluronidase activity than a composition that is identical, except that the composition does not contain the Lys-Lys.—; and At Column 232, Line 32 to Line 38, please replace with:
—50. A composition, comprising:
    a soluble PH20 polypeptide at a concentration of between 10 U/mL to 5000 U/mL, inclusive, wherein the soluble PH20 polypeptide is active at neutral pH; and
    lysyl lysine (Lys-Lys) at a concentration of 10 mM to 200 mM, inclusive, wherein the pH of the composition is between about 6.5 to 8.0, inclusive.—.